United States Patent 7,745,391 (HUMAN THROMBOSPONDIN POLYPEPTIDE) - sequence listing, part 96

SEQ ID NO: 305613 - DNA, 1545 bp, Homo sapiens
cgagccccaagcttaccacctgcacccggagagctgtgtcaccatgtgggtcccggttgtcttcctcaccctgtccgtgacgtggattgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305614 - DNA, 2580 bp, Homo sapiens
  misc_feature (2475)..(2475): n is a, c, g, or t
  misc_feature (2478)..(2478): n is a, c, g, or t
  misc_feature (2547)..(2547): n is a, c, g, or t
  misc_feature (2559)..(2560): n is a, c, g, or t
  misc_feature (2568)..(2568): n is a, c, g, or t
  misc_feature (2572)..(2573): n is a, c, g, or t
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaaaanaanaaaagaaaaaaaaaaacaaaaaacaaacaagcacaaccaacaaaaacaaaaacaaaaaaaaaacacttngtgcggcgcgcnngcccggcncccnnaagaaaa

SEQ ID NO: 305615 - DNA, 1515 bp, Homo sapiens
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaactcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305616 - DNA, 2452 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgcggccgcgaatttagtagtagtagtcgacc

SEQ ID NO: 305617 - DNA, 1609 bp, Homo sapiens
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttgtacgcctgggccagatggtgcagccgggagcccagatgcctgggtctgagggaggaggggacaggactcctgggtctgagggaggagggccaaggaaccaggtggggtccagcccacaacagtgtttttgcctggcccgtatcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 305618 - DNA, 2512 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305619 - DNA, 1512 bp, Homo sapiens
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305620 - DNA, 1394 bp, Homo sapiens
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305621 - DNA, 1141 bp, Homo sapiens
  misc_feature (7)..(7): n is a, c, g, or t
agctcgnacccgagggcgcagcgttgaaccagatgagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305622 - DNA, 1350 bp, Homo sapiens
gcggtcgactactactactaaattcgcggccgcgtcgacgtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccccaccggccaggactggagcccctacccctctgttggaatccctgcccaccttcttctggaagtcggctctggagacatttctctcttcttccaaagctgggaactgctatctgttatctgcctgtccaggtctgaaagataggattgcccaggcagaaactgggactgacctatctcactctctccctgcttttacccttagggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305623 - DNA, 1165 bp, Homo sapiens
cgcggtctaacacttttcgctcgcgcccctattttcgcagatttgtgtagcggatacaatctccccccgggaaacacctatgaccttgattccgccaagcctttaatacgacctacttatgggaaaagctgctccgcttgcaggtacgggtccgaattccgcggccgcctactactactaaattcgcggccgcgtcgacggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305624 - DNA, 1237 bp, Homo sapiens
gggctcaactgctgcccctcagcccgtaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccagaagatgggtcagatggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305625 - DNA, 854 bp, Homo sapiens
gcggtcgactactactactaaattcgcggccgcgtcgacgctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305626 - DNA, 824 bp, Homo sapiens
gcggtcgactactactactaaattcgcggccgcgtcgacgtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305627 - DNA, 923 bp, Homo sapiens
cgcggtctaacacttttcgctcgcgcccctattttcgcagatttgtgtagcggatacaatctccccccgggaaacacctatgaccttgattccgccaagcctttaatacgacctacttatgggaaaagctgctccgcttgcaggtacgggtccgaattccgcggccgcctactactactaaattcgcggccgcgtcgactttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305628 - DNA, 861 bp, Homo sapiens
cgcggtctaacacttttcgctcgcgcccctattttcgcagatttgtgtagcggatacaatctccccccgggaaacacctatgaccttgattccgccaagcctttaatacgacctacttatgggaaaagctgctccgcttgcaggtacgggtccgaattccgcggccgcctactactactaaattcgcggccgcgtcgacccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305629 - DNA, 636 bp, Homo sapiens
gcggtcgactactactactaaattcgcggccgcgtcgacggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305630 - DNA, 758 bp, Homo sapiens
cgcggtctaacacttttcgctcgcgcccctattttcgcagatttgtgtagcggatacaatctccccccgggaaacacctatgaccttgattccgccaagcctttaatacgacctacttatgggaaaagctgctccgcttgcaggtacgggtccgaattccgcggccgcctactactactaaattcgcggccgcgtcgacgatggggtgtctgtgttatttgtggggtacagagatgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305631 - DNA, 721 bp, Homo sapiens
cgcggtctaacacttttcgctcgcgcccctattttcgcagatttgtgtagcggatacaatctccccccgggaaacacctatgaccttgattccgccaagcctttaatacgacctacttatgggaaaagctgctccgcttgcaggtacgggtccgaattccgcggccgcctactactactaaattcgcggccgcgtcgacaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305632 - DNA, 2329 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctggaggcacaacgcaccagacactcacagtactcaggaggctgagaacaggttgaacctgggaggtggaggttgcaatgagctgagatcaggccactgcaccccagcatggatgacagagtgagactccatctt

SEQ ID NO: 305633 - DNA, 562 bp, Homo sapiens
gcggtcgactactactactaaattcgcggccgcgtcgacgaaagaggggtgggatccacactgagagagtggagagtgacatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305634 - DNA, 2225 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacccatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 305635 - DNA, 2219 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagacaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 305636 - DNA, 1876 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaagtttactacaatagggagttgataggggtgctcaggggttggccacgatggtatccttgatccacttccggtaatgcaccgtcgacgcggccgaaaatt

SEQ ID NO: 305637 - DNA, 2059 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccccaccggccaggactggagcccctacccctctgttggaatccctgcccaccttcttctggaagtcggctctggagacatttctctcttctttcagacctggacaggcagataacagatagcagttcccaggtcgaccggccgcgaat

SEQ ID NO: 305638 - DNA, 1727 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggggactgcttcagtttcgtcgacgcggccgcgaatttagtagtagtagtcgacc

SEQ ID NO: 305639 - DNA, 1733 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgattctgggggcccacttgtctgttcagtggcttcggtggccctcagagccgccagag

SEQ ID NO: 305640 - DNA, 1853 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggagacacactgaaatcagcaaaggaaacaggcatctaagtggggatgtgaagaaaacagggaaaatctttcagttgttttctcccagtggggtgttgtggacagcacttaaatcacacagaagtgatgtgtgaccttgtgtatgaagtatttccaactaaggaagctcacctgagcctta

SEQ ID NO: 305641 - DNA, 682 bp, Homo sapiens
cgcggtctaacacttttcgctcgcgcccctattttcgcagatttgtgtagcggatacaatctccccccgggaaacacctatgaccttgattccgccaagcctttaatacgacctacttatgggaaaagctgctccgcttgcaggtacgggtccgaattccgcggccgcctactactactaaattcgcggccgcgtcgaccatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305642 - DNA, 523 bp, Homo sapiens
gcggtcgactactactactaaattcgcggccgcgtcgacgcatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305643 - DNA, 711 bp, Homo sapiens
gcggtcgactactactactaaattcgcggccgcgtcgacgtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctgcatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305644 - DNA, 514 bp, Homo sapiens
gctaataatactaaattagcggagtacgacgcatgtgctggacactgtccatgaagcactgagcagaagctggaggcacaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305645 - DNA, 475 bp, Homo sapiens
gcggtcgactactactactaaattcgcggccgcgtcgacgaacgcaccagacactcacagcaaggatggagctgaaaacataacccactctgtcctggaggcactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtgaaaaaacaacaaaaaaaacaccccaaaaacttttttgggcccggtttggccccgagaaaaaagtttttaaaccctttgttgggggcgcgggggccccatatgttgtcttggacctttggccaaatgtttcccagagaaaccccggggccaaacacagtgggggggattcccca

SEQ ID NO: 305646 - DNA, 965 bp, Homo sapiens
gagctcggtacccaaacgacccgaagaccggagagctgtgtcaccatgtgggtcccggttgtcttcctcaccctgtccgtgacgtggattggtgagaggggccatggttggggggatgcaggagagggagccagccctgactgtcaagctgaggctctttcccccccaacccagcaccccagcccagacagggagctgggctcttttctgtctctcccagccccactccaagcccatacccccagcccctccatattgcaacagtcctcactcccacaccaggtccccgctccctcccacttaccccagaactttctccccattgcccagccaactccctgctcccagctgctttactaaaggggaagttcctgggcatctccgtgtttctctttgtggggctcaaaacctccaaggacctctctcaatgccattggttccttggaccgtatcactggtccacctcctgagcccctcaatcctatcacagtctactgacttttcccattcagctgtgagtgtccaaccctatcccagagaccttgatgcttggcctcccaatcttgccctaggatacccagatgccaaccagacacctccttcttcctagccaggctatctggcctgagacaacaaatgggtccctcagtctggcaatgggactctgagaactcctcattccctgactcttagccccagactcttcattcagtggcccacattttccttaggaaaaacatgagcatccccagccacaactgccagctctctgattccccaaatctgcatccttttcaaaacctaaaaacaaaaagaaaaacaaataaaacaaaaccaactcagaccagaactgttttctcaacctgggacttcctaaactttccaaaaccttcctcttccagcaactgaacctcgccataaggcacttatccctggttcctagcaccgcttatcccctcagaatc

SEQ ID NO: 305647 - DNA, 1026 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagactccgcctcaaaaaaaaaaaa

SEQ ID NO: 305648 - DNA, 1673 bp, Homo sapiens
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaattagccaggcgtggtggcgcatgcctgtagtcccagctactcaggaggctgagggaggagaattgcttgaacctgggaggtggaggttgcagtgagccgagaccgtgccactgcactccagcctgggtgacagagtgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcaagcaaggactgtgggaggtgggctttgtagtaacaagagggcagggtgaactctgattcccatgggggaatgtgatggtcctgttacaaatttttcaagctggcagggaataaaacccattacggtgaggacctgtggagggcggctgccccaactgataaaggaaatagccaggtgggggcctttcccattgtaggggggacatatctggcaatagaagcctttgagaccctttagggtacaagtactgaggcagcaaataaaatgaaatcttatttttcaactttatactgcatggg

SEQ ID NO: 305649 - DNA, 806 bp, Homo sapiens
aagtttcccttctcccagtccaagaccccaaatcaccacaaaggacccaatccccagactcaagatatggtctgggcgctgtcttgtgtctcctaccctgatccctgggttcaactctgctcccagagcatgaagcctctccaccagcaccagccaccaacctgcaaacctagggaagattgacagaattcccagcctttcccagctccccctgcccatgtcccaggactcccagccttggttctctgcccccgtgtcttttcaaacccacatcctaaatccatctcctatccgagtcccccagttcctcctgtcaaccctgattcccctgatctagcaccccctctgcaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctactgggaagcctagagaaggctgtgagccaaggagggagggtcttcctttggcatgggatggggatgaagtaaggagagggactggaccccctggaagctgattcactatggggggaggtgtattgaagtcctccagacaaccctcagatttgatgatttcctagtagaactcacagaaataaagagctgttatactgtg

SEQ ID NO: 305650 - DNA, 921 bp, Homo sapiens
  misc_feature (888)..(888): n is a, c, g, or t
  misc_feature (900)..(901): n is a, c, g, or t
  misc_feature (909)..(909): n is a, c, g, or t
  misc_feature (913)..(914): n is a, c, g, or t
gagctcggtacccaaacgacccgaagaccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagtgagtaggggcctggggtctggggagcaggtgtctgtgtcccagaggaataacagctgggcattttccccaggataacctctaaggccagccttgggactgggggagagagggaaagttctggttcaggtcacatggggaggcagggttggggctggaccaccctccccatggctgcctgggtctccatctgtgttcctctatgtctctttgtgtcgctttcattatgtctcttggtaactggcttcggttgtgtctctccgtgtgactattttgttctctctctccctctcttctctgtcttcagtctccatatctccccctctctctgtccttctctggtccctctctagccagtgtgtctcaccctgtatctctctgccaggctctgtctctcggtctctgtctcacctgtgccttctccctactgagcacacgcatgggatgggcctggggggaccctgagaaaaggaagggctttggctgggcgcggtggctcacacctgtaatcccagcactttgggaggccaaggcaggtagatcacctgaggtcaggagttcgagaccagcctggccaactggtgaaaccccatctctactaaaaatacaaaaaacaaaaacaaaaaaaaaacacttngtgcggcgcgcnngcccggcncccnnaagaaaa

SEQ ID NO: 305651 - DNA, 609 bp, Homo sapiens
cgagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttttcttgaccccagtagttctaagctgcagcaagtatgatcatgccactgccctccagctgggtaacagagca

SEQ ID NO: 305652 - DNA, 738 bp, Homo sapiens
gacagggcctggctcaggtgtccagaggctgccgctggcctccctatgggatcagactgcagggagggagggcagcagggatgtggagggagtgatgatggggctgacctgggggtggctccaggcattgtccccacctgggcccttacccagcctccctcacaggctcctggccctcagtctctcccctccactccattctccacctacccacagtgggtcattctgatcaccgaactgaccatgccagccctgccgatggtcctccatggctccctagtgccctggagaggaggtgtctagtcagagagtagtcctggaaggtggcctctgtgaggagccacggggacagcatcctgcagatggtcctggcccttgtcccaccgacctgtctacaaggactgtcctcgtggaccctcccctctgcacaggagctggaccctgaagtcccttccccaccggccaggactggagcccctacccctctgttggaatccctgcccaccttcttctggaagtcggctctggagacatttctctcttcttccaaagctgggaactgctatctgttatctgcctgtccaggtctgaaagataggattgcccaggcagaaactgggactgacctatctcactctctccctgcttttacccttagggtgattctgggggcccacttgtctgtaatggtgtgcttcaaggtatcacgtcatggggcagtgaaccatgtgccctgcc

SEQ ID NO: 305653 - DNA, 1514 bp, Homo sapiens
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305654 - DNA, 1696 bp, Homo sapiens
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaaaaaaaattggtgagtattaagaggggggcagcacattggaagccctcatgagtgcagggcccgccacttgtccagagggccaccactggggatgtacttgaccccacaccatctgggatgagccgcttttagccaccatgtcttcaaatcatcaacattgcttggtgcccactctttgaggg

SEQ ID NO: 305655 - DNA, 1854 bp, Homo sapiens
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaaaattggggccccctttgcccaattcatttttaaattcgaaaaatttttaactgggccccaaaattgacccaattttggcaaatgccccttaaagggggggatttaaaaataaaggggcccggttttaaaaacgcttaattggaaaaaccctgggggtccccaacttaaaagcctttgaaaaaaaacccctttttccaaggggggaaaaaagg

SEQ ID NO: 305656 - DNA, 1988 bp, Homo sapiens
ctaaaagcttcacttccattcattgccatagaaaaacaatgtttgatgtgtatgttgccccctaagaacatgacaatcaggttctttcctggatttaagcaggcatttgtttgtagcgggaagtggaggaaatgcctctttctctactccagcccctatctcctcatctggactgcttgcacgtcctgtcctgtgccattcttggaggaattaggacttccataccctgatagggtgttagagtgagtgtgtgagagtcagtgacccttccaaggagggaacagggatttcctgcggattctctgcccttcagaggaaatgaaagggagtcgtctcactgatcctcaaggagatggatttccacagggggtcccttataggccagtgtgctgattctgttcatgtacctttggactctatctgcaagatcctcttgccatgggggtggagggggtgttgcagagaagtccattaggacgtgggaaggcaggggccccaaaatagaagagggtagtagtttgggtcaggagagctgcattctagactccacttctagatgaactgtaccatccattcagggatattagttccccattttaaggatggagaagctgaggtttcgaggctccctactaatgcggttaggaactgaactctaatcctggcttctttagggttgttctcaacctcagcaaatgcatttgttgctctgctcccctgctgctttaaaagcagaaacgtggggcacccttgccaggccctgaaacttactattgtcaggaacagagctggcatgctgttgggacataactcttcctggaaaccattacaaggtcctttacagtgagagtcagtgaaaatcaggttagggaatgtggccatcctcatggcccagcctggttttgagggaaggaagtgatctcctgggggcccgaaaggggcagatgctttgggagggctcatggggtctgcaatgtttcctttccagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305657 - DNA, 1934 bp, Homo sapiens
ctaaaagcttcacttccattcattgccatagaaaaacaatgtttgatgtgtatgttgccccctaagaacatgacaatcaggttctttcctggatttaagcaggcatttgtttgtagcgggaagtggaggaaatgcctctttctctactccagcccctatctcctcatctggactgcttgcacgtcctgtcctgtgccattcttggaggaattaggacttccataccctgatagggtgttagagtgagtgtgtgagagtcagtgacccttccaaggagggaacagggatttcctgcggattctctgcccttcagaggaaatgaaagggagtcgtctcactgatcctcaaggagatggatttccacagggggtcccttataggccagtgtgctgattctgttcatgtacctttggactctatctgcaagatcctcttgccatgggggtggagggggtgttgcagagaagtccattaggacgtgggaaggcaggggccccaaaatagaagagggtagtagtttgggtcaggagagctgcattctagactccacttctagatgaactgtaccatccattcagggatattagttccccattttaaggatggagaagctgaggtttcgaggctccctactaatgcggttaggaactgaactctaatcctggcttctttagggttgttctcaacctcagcaaatgcatttgttgctctgctcccctgctgctttaaaagcagaaacgtggggcacccttgccaggccctgaaacttactattgtcaggaacagagctggcatgctgttgggacataactcttcctggaaaccattacaaggtcctttacagtgagagtcaggaaggaagtgatctcctgggggcccgaaaggggcagatgctttgggagggctcatggggtctgcaatgtttcctttccagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305658 - DNA, 1938 bp, Homo sapiens
ctaaaagcttcacttccattcattgccatagaaaaacaatgtttgatgtgtatgttgccccctaagaacatgacaatcaggttctttcctggatttaagcaggcatttgtttgtagcgggaagtggaggaaatgcctctttctctactccagcccctatctcctcatctggactgcttgcacgtcctgtcctgtgccattcttggaggaattaggacttccataccctgatagggtgttagagtgagtgtgtgagagtcagtgacccttccaaggagggaacagggatttcctgcggattctctgcccttcagaggaaatgaaagggagtcgtctcactgatcctcaaggagatggatttccacagggggtcccttataggccagtgtgctgattctgttcatgtacctttggactctatctgcaagatcctcttgccatgggggtggagggggtgttgcagagaagtccattaggacgtgggaaggcaggggccccaaaatagaagagggtagtagtttgggtcaggagagctgcattctagactccacttctagatgaactgtaccatccattcagggatattaggcggttaggaactgaactctaatcctggcttctttagggttgttctcaacctcagcaaatgcatttgttgctctgctcccctgctgctttaaaagcagaaacgtggggcacccttgccaggccctgaaacttactattgtcaggaacagagctggcatgctgttgggacataactcttcctggaaaccattacaaggtcctttacagtgagagtcagtgaaaatcaggttagggaatgtggccatcctcatggcccagcctggttttgagggaaggaagtgatctcctgggggcccgaaaggggcagatgctttgggagggctcatggggtctgcaatgtttcctttccagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305659 - DNA, 1460 bp, Homo sapiens
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305660 - DNA, 2677 bp, Homo sapiens
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaagaaggtgaggcccagcaggtgggtggtgggaactctcctgtcagaggatgtagcttgagtcggctgtgacaagcagacctggcccactccttcctggtcctgatgccctggaaagaaatgcttttcccccaaaacctagtggccatttctcagttaaactttgtcaaactgtgaacacatggactttcaggagaggagcccactggatgcaaagaaaatgtagttccggacgataggttacttcatgtctctgagctcctctctaaagggtgtgagaacattgagttacattgttccaaaacttagtacaagggcctaactgctttcacccccattgtatgatttgcctccctttaaaaaagttgtcataaaatagacataataagtaatgcatgttattctgcaaccactaccaatatctaccttcagaattttcatcttcccaaactgaagctcggaactcattaaacatcaactctccattatcttaattatgtctgttttgaattctaccacttgagggcgacagagaatcaaagtcggagtgatttgatttgagaaaataaattacttccacaaacatgcctacccagaaaaagggaggattaaaccattttctcaacattttggaatttcatctgagaataacgataaatggaggaaagttaattcttaaattatccaaatgaatgccttaatcctcacttgatttagtttatgtaaaagaaccttgtagattgcagaggaaagttattcaaaatctagaaatgtcttctgctaaattcttaattaagagttatgcccactcttctaaccagatggcgggtgccaaaagtattcagtaggtggcaggaagagttgggaagagttttgtggtgttggtgaggctcttgccaggggatgtctctgtgcaggtgttgagagagtgattggtgagggagagaatggtgttcttgttctttatctgaacaacttaagacagactaactgcaggtgggaaaaagaggcccagagggagcacatcacatgacacctagtcccaggtccccgtggccagatcgtagggccactcctgcttctacaaaacctcttccatcagtcattgtctaggctgataattcactgtgtcttgttagatatgctaatgtcaagttattctcttaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305661 - DNA, 2731 bp, Homo sapiens
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaagaaggtgaggcccagcaggtgggtggtgggaactctcctgtcagaggatgtagcttgagtcggctgtgacaagcagacctggcccactccttcctggtcctgatgccctggaaagaaatgcttttcccccaaaacctagtggccatttctcagttaaactttgtcaaactgtgaacacatggactttcaggagaggagcccactggatgcaaagaaaatgtagttccggacgataggttacttcatgtctctgagctcctctctaaagggtgtgagaacattgagttacattgttccaaaacttagtacaagggcctaactgctttcacccccattgtatgatttgcctccctttaaaaaagttgtcataaaatagacataaaatgtactgttttaactattttgaagcataggtttctgtggcattaagtaacaataagtaatgcatgttattctgcaaccactaccaatatctaccttcagaattttcatcttcccaaactgaagctcggaactcattaaacatcaactctccattatcttaattatgtctgttttgaattctaccacttgagggcgacagagaatcaaagtcggagtgatttgatttgagaaaataaattacttccacaaacatgcctacccagaaaaagggaggattaaaccattttctcaacattttggaatttcatctgagaataacgataaatggaggaaagttaattcttaaattatccaaatgaatgccttaatcctcacttgatttagtttatgtaaaagaaccttgtagattgcagaggaaagttattcaaaatctagaaatgtcttctgctaaattcttaattaagagttatgcccactcttctaaccagatggcgggtgccaaaagtattcagtaggtggcaggaagagttgggaagagttttgtggtgttggtgaggctcttgccaggggatgtctctgtgcaggtgttgagagagtgattggtgagggagagaatggtgttcttgttctttatctgaacaacttaagacagactaactgcaggtgggaaaaagaggcccagagggagcacatcacatgacacctagtcccaggtccccgtggccagatcgtagggccactcctgcttctacaaaacctcttccatcagtcattgtctaggctgataattcactgtgtcttgttagatatgctaatgtcaagttattctcttaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305662 - DNA, 3151 bp, Homo sapiens
ctaaaagcttcacttccattcattgccatagaaaaacaatgtttgatgtgtatgttgccccctaagaacatgacaatcaggttctttcctggatttaagcaggcatttgtttgtagcgggaagtggaggaaatgcctctttctctactccagcccctatctcctcatctggactgcttgcacgtcctgtcctgtgccattcttggaggaattaggacttccataccctgatagggtgttagagtgagtgtgtgagagtcagtgacccttccaaggagggaacagggatttcctgcggattctctgcccttcagaggaaatgaaagggagtcgtctcactgatcctcaaggagatggatttccacagggggtcccttataggccagtgtgctgattctgttcatgtacctttggactctatctgcaagatcctcttgccatgggggtggagggggtgttgcagagaagtccattaggacgtgggaaggcaggggccccaaaatagaagagggtagtagtttgggtcaggagagctgcattctagactccacttctagatgaactgtaccatccattcagggatattagttccccattttaaggatggagaagctgaggtttcgaggctccctactaatgcggttaggaactgaactctaatcctggcttctttagggttgttctcaacctcagcaaatgcatttgttgctctgctcccctgctgctttaaaagcagaaacgtggggcacccttgccaggccctgaaacttactattgtcaggaacagagctggcatgctgttgggacataactcttcctggaaaccattacaaggtcctttacagtgagagtcagtgaaaatcaggttagggaatgtggccatcctcatggcccagcctggttttgagggaaggaagtgatctcctgggggcccgaaaggggcagatgctttgggagggctcatggggtctgcaatgtttcctttccagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaagaaggtgaggcccagcaggtgggtggtgggaactctcctgtcagaggatgtagcttgagtcggctgtgacaagcagacctggcccactccttcctggtcctgatgccctggaaagaaatgcttttcccccaaaacctagtggccatttctcagttaaactttgtcaaactgtgaacacatggactttcaggagaggagcccactggatgcaaagaaaatgtagttccggacgataggttacttcatgtctctgagctcctctctaaagggtgtgagaacattgagttacattgttccaaaacttagtacaagggcctaactgctttcacccccattgtatgatttgcctccctttaaaaaagttgtcataaaatagacataataagtaatgcatgttattctgcaaccactaccaatatctaccttcagaattttcatcttcccaaactgaagctcggaactcattaaacatcaactctccattatcttaattatgtctgttttgaattctaccacttgagggcgacagagaatcaaagtcggagtgatttgatttgagaaaataaattacttccacaaacatgcctacccagaaaaagggaggattaaaccattttctcaacattttggaatttcatctgagaataacgataaatggaggaaagttaattcttaaattatccaaatgaatgccttaatcctcacttgatttagtttatgtaaaagaaccttgtagattgcagaggaaagttattcaaaatctagaaatgtcttctgctaaattcttaattaagagttatgcccactcttctaaccagatggcgggtgccaaaagtattcagtaggtggcaggaagagttgggaagagttttgtggtgttggtgaggctcttgccaggggatgtctctgtgcaggtgttgagagagtgattggtgagggagagaatggtgttcttgttctttatctgaacaacttaagacagactaactgcaggtgggaaaaagaggcccagagggagcacatcacatgacacctagtcccaggtccccgtggccagatcgtagggccactcctgcttctacaaaacctcttccatcagtcattgtctaggctgataattcactgtgtcttgttagatatgctaatgtcaagttattctcttaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305663 - DNA, 1470 bp, Homo sapiens
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaagcaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305664 - DNA, 1460 bp, Homo sapiens
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacatatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305665 - DNA, 1944 bp, Homo sapiens
ctaaaagcttcacttccattcattgccatagaaaaacaatgtttgatgtgtatgttgccccctaagaacatgacaatcaggttctttcctggatttaagcaggcatttgtttgtagcgggaagtggaggaaatgcctctttctctactccagcccctatctcctcatctggactgcttgcacgtcctgtcctgtgccattcttggaggaattaggacttccataccctgatagggtgttagagtgagtgtgtgagagtcagtgacccttccaaggagggaacagggatttcctgcggattctctgcccttcagaggaaatgaaagggagtcgtctcactgatcctcaaggagatggatttccacagggggtcccttataggccagtgtgctgattctgttcatgtacctttggactctatctgcaagatcctcttgccatgggggtggagggggtgttgcagagaagtccattaggacgtgggaaggcaggggccccaaaatagaagagggtagtagtttgggtcaggagagctgcattctagactccacttctagatgaactgtaccatccattcagggatattagttccccattttaaggatggagaagctgaggtttcgaggctccctactaatgcggttaggaactgaactctaatcctggcttctttagggttgttctcaacctcagcaaatgcatttgttgctctgctcccctgctgctttaaaagcagaaacgtggggcacccttgccaggccctgaaacttactattgtcaggaacagagctggcatgctgttgggacataactcttcctggaaaccattacaaggtcctttacagtgagagtcagtgaaaatcaggttagggaatgtggccatcctcatggcccagcctggttttgagggaaggaagtgatctcctgggggcccgaaaggggcagatgctttgggagggctcatggggtctgcaatgtttcctttccagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaagcaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305666 - DNA, 935 bp, Homo sapiens
tttaacacacatgggaagtcattattgcacatgccactcggtcactgtctctattttatgatgagaaccaggagggtgtgagatttgcctgcatcatgggcagctggtttcacagccgggactcttggcttggctctgcagtgctcggctgcactgaaaaaagggccagctatggctctactttccctgtcagcttgtcatctgctgctcttgaccttggtcttgtctttgcagtgtgagacatccatggatggagaggcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305667 - DNA, 763 bp, Homo sapiens
gagagagagagagagagagagagagagagagagagagagagagagagagagagagagagagagagagagagagagagagagagagagcgggactctgctggtgcgtctacccttggaatgggaagaggatccctgggtctccagagatcaggggagaccccaactgccagatgtattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305668 - DNA, 529 bp, Homo sapiens
  misc_feature (25)..(25): n is a, c, g, or t
  misc_feature (64)..(64): n is a, c, g, or t
  misc_feature (92)..(93): n is a, c, g, or t
aaaaaaaaacacaagaacatgcaanataaaaaaaaaaaagaaaaagaaaaaaaaaaaagaaacnactttaaaataacaacacaaaacaaaannattgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaa

SEQ ID NO: 305669 - DNA, 2203 bp, Homo sapiens
atcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaagaaggtgaggcccagcaggtgggtggtgggaactctcctgtcagaggatgtagcttgagtcggctgtgacaagcagacctggcccactccttcctggtcctgatgccctggaaagaaatgcttttcccccaaaacctagtggccatttctcagttaaactttgtcaaactgtgaacacatggactttcaggagaggagcccactggatgcaaagaaaatgtagttccggacgataggttacttcatgtctctgagctcctctctaaagggtgtgagaacattgagttacattgttccaaaacttagtacaagggcctaactgctttcacccccattgtatgatttgcctccctttaaaaaagttgtcataaaatagacataataagtaatgcatgttattctgcaaccactaccaatatctaccttcagaattttcatcttcccaaactgaagctcggaactcattaaacatcaactctccattatcttaattatgtctgttttgaattctaccacttgagggcgacagagaatcaaagtcggagtgatttgatttgagaaaataaattacttccacaaacatgcctacccagaaaaagggaggattaaaccattttctcaacattttggaatttcatctgagaataacgataaatggaggaaagttaattcttaaattatccaaatgaatgccttaatcctcacttgatttagtttatgtaaaagaaccttgtagattgcagaggaaagttattcaaaatctagaaatgtcttctgctaaattcttaattaagagttatgcccactcttctaaccagatggcgggtgccaaaagtattcagtaggtggcaggaagagttgggaagagttttgtggtgttggtgaggctcttgccaggggatgtctctgtgcaggtgttgagagagtgattggtgagggagagaatggtgttcttgttctttatctgaacaacttaagacagactaactgcaggtgggaaaaagaggcccagagggagcacatcacatgacacctagtcccaggtccccgtggccagatcgtagggccactcctgcttctacaaaacctcttccatcagtcattgtctaggctgataattcactgtgtcttgttagatatgctaatgtcaagttattctcttaggagccctgccgaatagaactctacagagtcgtagagagtttagccaaggcacaggagacatcaggagaagaaatttccaaattttacctgccaaactgcaacaagaatggattttatcacagcagacaggtaggtggccttgccagtgtgcgtcgtcagggtgaaagggactactgccctacattcctgccaagccacggtcattcatgtcaaagaaggtccactccaaagtagacaccagaagtggttgtattgagccagatccacccctctgggaacctggaacagctaggtgaagaaagcctattgaacaggtcaatatgtcaccaccagaggtggaaaacctgcgctggacc

SEQ ID NO: 305670 - DNA, 711 bp, Homo sapiens
agaaggaaggaccatttctgaggtgatgaaaatgttctatattgtgattactgtatttcttacacaactatgtatacatttatcgaaactcctcagattatacaacttaaatttgatcaattttaatgtatatagattgaactcagtaaaactgaattttaaaatgtgagataatagctatcgttaacttaaaaagcaccatacgaattgattattgttgatagtgatagtgatgtgaaaaggactgtgtctctttaacaaaggcagatgtaatcaatgtgaatttcattagcaatctctagattttatggttctgtgtacttttacttttaaaatattattattgactttttaccagaaaatattttctgtacaatttcttgcatctaatttttttatcaaacatgaatttgcaacataatttttgaaaactcatgtttcttgagtctacagctataaacaggaccttgcctgtcttgttgaccactggcatagttggtgtacctattgttgtgtaacatattactataaaattcagtgacctgaaacaactaacttttattacctcatggtttctgtgatccgcttcccagcgaactcatttgggcccctctgccaggcctctcacaacatgaaaactggcttctccaaaaagtcatacaagagagtgcccaagatgcaatctgccatctttttgtaacctaaaatctg

SEQ ID NO: 305671 - DNA, 155 bp, Homo sapiens
caacatgatactgtgaggagattctcggacactagtcctctaacagtatcatgttgcaggaattccccattgctctgcaacttccaaaccagtttgagtcatacaaatgttttctaaacttttattgtattactgcaataaatcttttaacagta

SEQ ID NO: 305672 - DNA, 4944 bp, Homo sapiens
  misc_feature (3686)..(3686): n is a, c, g, or t
  misc_feature (3692)..(3692): n is a, c, g, or t
  misc_feature (3843)..(3843): n is a, c, g, or t
attgataagggtccgtgtcgactttgaggtcaggacagaaatactgaatgactttacacttaggaaaaaatagctaaataattaagatgcaggctgtagtgttcaaaccaatagagcagggaaagggaaatgtagatactttattaattcagtggaagataggaaagttagaagcaaaggaggctgggcacagtggctcatgcctgtaatcctagcactttgggaggccaagacaggtggatcacctgaggttaggggtttcaccatgttggccaggatggtcttgatctcctaacctcttgatctgccctccttggcctcccaaagtgctgcgattacaggcgtgagccaccgcactggcctaatttctcttttctctgcattgaactagaaaaacatcgttctctttttcgtaatgttccatagttacaaaagctataacataaggtctttttcttcattatgttttctgacatatctgaaaataagcagtgatcccaggtagataatcatattaaccataagagaccaacgtttgtgatatttattacatgcttttttcagagatggaaaataatgtcctgcaagatgaggattgaacagttaaaacaaacaatatgtaaaggaaatgaagaaatggagaaaaattctgaaggccttctcaaaaccaaggaaaagaatcagaagctttacagtcgagcacaacggcaccaagagaaaaaggagaagattcagaggcataatcgcaaacttggtgacctggtagaaaaaaagaccattgacttaagaagtcattatgagcgtctggcaaatcttcgacgatcccatatattagagctcacctctgtcatttttccaatcgaggaagtaaagacgggtgtgagagaccccgcagatgtgtcttcagagagtgacagtgccatgacctccagcactgtgagcaagcttgctgaagcccggaggacaacttacctctcaggacgatgggtctgtgacgatcacaacggagacaccagcattagcattacagggccttggattagcctccctaacaatggggactactctgcctactacagctgggtggaggagaagaaaacaacccaggggcctgacatggagcagagtaaccctgcctacaccatcagtgctgcgctgtgctatgcaactcagctggtcaacattctgtctcatatacttgatgtaaatcttcccaaaaagctctgcaacagtgaattttgtggcgaaaatctaagcaagcagaaatttactcgagcagtgaagaaactgaatgcaaatattctttacctttgtttttctcagcatgtaaatttagatcaattacaaccactgcataccctcaggaatctaatgtacctggtcagtccaagctctgaacacctaggcaggtcagggccctttgaagtacgagcagaccttgaggagtccatggaatttgtggatcccggagttgctggagaatcagatgagagcggagatgagcgcgtcagcgatgaagaaaccgacctgggcacagactgggagaacttgcctagtccccggttttgtgatatcccttcccagtctgtggaagtctcccagagtcagagcacccaggcgtccccacccatcgcgagcagcagtgcaggtgggatgatctcctctgcagcagcctcggtgacctcctggtttaaagcttacactggacaccgttaacgagcatggaccaaaacataccaaatctgcatcaagaaagttcttctcccactacactctagtaaacattttctgtttaagttaagatagtgtctggaacaaagaggttaaagtgttgttttgttttgtctttttaagcagggagacaaacatttctatttgccaagtggcctgtgatggtgaccaacatgcttatgataattaagagaacaggggtcgaaggtctttctacccagaccagtgctggtggaaggaggacctgtgcgtgtggccagttctgccaaggaagcagttgatttgggttccctctgggcccgggccaccgggcccacagatatgggtcagtgtgctggtccttgcggtgctgagactgttcctgacactttaagttttagaggttggttgaatcacaagaggtgattcttgattattaggacatgaaagataaaagctctttaataagagtttttctgccattgttttttgtatgagaaccagcaggcaatttaaaatttctaatttggtcctttgattttgtttgggaggggtgagttacacgtattttattcatgctgctctgtcgtagtttgtcagacattcctgtttttctttcccccacacaccaaagaaaatgaaagtctttttctttaggacccacatccataaatggaagaaatcctggctgcaataatgtctagagagtttttaactattttcttgtattctgaggggaattaagcttattcttacctagttgaattcctgccatccacactatgagcattttgaaattgaacttatattttctgggtgaaaataagtcatgaaggtcattcccttatgtaagctcaatgcctgcctgggcacaggggaaaagccacttagttaagtggcctctggtcattcttgtggtgtccactttctttctatgggattgagtaggtggcaggtgttttcaggggaaaccatcctacttgtttccccgaactctttgttgctctgaggacacagctttgctcagaaatgcagcgcagatccttacggctgatgctactctgctctgttctggggaaagcacaatataaagaaagaatttcccagccaggcgcagtggctcacgcctgtaatcccagcactttaggaggccgaggcaggcggatcacttgaggtcaggagtttgagagcagcctggctaacatggtgaaaccctgtttctactaaaaatacaaaaaattaccgggtgtggtggcgcacgcctgtaatcccagctactcgggaggctgcggcaggagaatcgcttgaaccgggaggcagaggttgcagtgagccgagattgtgccattgcactccagcctgggcaacaagagcgaaactccgtctcaaaaaaaaaaagaatttccctcagcaggagatcattttcagctcacgtgtcttgtcattcttttagtgacaatcttacaagaaaactataatgagagaggcattatgtacaaatatgtaagtagtttatttttaataactgcaaaaaaatcctatgtaacaactaccaaaagaaatcctatgaaagagtcctaacaggcattattaccatatcttatgtgattggcatgatagcacctctgataaatcattcagaggtttgccatgccccagcttcttttctcatcataataattgtagttgatactttgcctccaagtccgaggtgctatatagcttttgctaatggtatatttggtgttttgtatagttttgggtagagttgcagaacggagtttatttctatccggtagtcacaaattccttggctctatgaattttccatgaaaggaggaagtaggcttttctcgttgtgggtggtcttttttttttttggagacggagtctcactcagctgcccaggctggagtgtagtggcaccatctccgctcactgcaaccaccatctcctgggttcaagcaattcttccntctcancctcccgagtagctgggattataggcacctgccatcatgcccagctaatttttgtattttagtaaagacgggggttttcaccatgttggccaggctggtcttgaactcctgacttcaggtgatccgcttgccttggcctcctaaagtgctnggattacaggcctgagccaccgcgcccggccccttatgggttcttctacactgctgggatctctgttttaagtgctcagcttcatgattgattgctgggcttccattttcccatccagttctggagttcgtagagagtgaagatggtagacttgaacagataaataaacttaacgatcttgtaagagttgtctagctacttaaaaccctcagaagtaagagcttagtctcacgagttgtaagagtgggatttggagcttggtggtggagactgacttcagctgagagatgcacaacagtcatggttttcttaagcctcttatgaaaccatgaatgagagatgaagctaaagaatagaatccagagatcacaaactcatctagagtacttccacaaaatttacaaagatgtgggaactttatggataggatatattttgtttgttgttgttaatatcaactagaggcactttacatagggttaagtgatcgaacccttttgtggttttgaacaccaacatactggcttacactgctgaaatattttgggtttcattattttgcactggatccaccctgtaaatactcttaagtatacatttcaaccactgttttttctactctttttgctgctcattaaaatctttcatgtaggtgccagaaccatatgtaaacagctttttaaaaaattgaagctggtattttgtttaaacaaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggaaaaacagtatatcaccattgggtagagtggacgggactcatgtaaggactcaatttggggaagagcattcagtggcatgctgttagaggactagtgtccgagaatctcctcacagtatcatgttgcaggaattccccattgctctgcaacttccaaaccagtttgagtcatacaaatgttttctaaacttttattgtattactgcaataaatcttttaacagta

SEQ ID NO: 305673 - DNA, 4372 bp, Homo sapiens
  misc_feature (2720)..(2720): n is a, c, g, or t
  misc_feature (2726)..(2726): n is a, c, g, or t
  misc_feature (2877)..(2877): n is a, c, g, or t
ttctttgtataccatttattacttattacactaaataatatccagagtatacatcaagtggctttttgttagaattgtctcattggagtgccgtgtatttacttcgtagacactgcagttctttacaacaggaagtcagacttaggaccagcatgggccatctcagtgaataggtttttttcctatgcacggtcatcaccaatgaagtaggcagacttgtgggaaagtgtggtatcatgattttatttataacttgggtggagattatttgggtaaaggaaaacgcaatcatatgtcaacacggagtgctgcatagacttggggaatgaatggggtgtgcggcgtccctcatcccctcaggtgagggccttcaggaagatggcatattttctggtgttgagaatggttgttatcctaaagagaccctcattgtctgcacacaggtcagggccctttgaagtacgagcagaccttgaggagtccatggaatttgtggatcccggagttgctggagaatcagatgagagcggagatgagcgcgtcagcgatgaagaaaccgacctgggcacagactgggagaacttgcctagtccccggttttgtgatatcccttcccagtctgtggaagtctcccagagtcagagcacccaggcgtccccacccatcgcgagcagcagtgcaggtgggatgatctcctctgcagcagcctcggtgacctcctggtttaaagcttacactggacaccgttaacgagcatggaccaaaacataccaaatctgcatcaagaaagttcttctcccactacactctagtaaacattttctgtttaagttaagatagtgtctggaacaaagaggttaaagtgttgttttgttttgtctttttaagcagggagacaaacatttctatttgccaagtggcctgtgatggtgaccaacatgcttatgataattaagagaacaggggtcgaaggtctttctacccagaccagtgctggtggaaggaggacctgtgcgtgtggccagttctgccaaggaagcagttgatttgggttccctctgggcccgggccaccgggcccacagatatgggtcagtgtgctggtccttgcggtgctgagactgttcctgacactttaagttttagaggttggttgaatcacaagaggtgattcttgattattaggacatgaaagataaaagctctttaataagagtttttctgccattgttttttgtatgagaaccagcaggcaatttaaaatttctaatttggtcctttgattttgtttgggaggggtgagttacacgtattttattcatgctgctctgtcgtagtttgtcagacattcctgtttttctttcccccacacaccaaagaaaatgaaagtctttttctttaggacccacatccataaatggaagaaatcctggctgcaataatgtctagagagtttttaactattttcttgtattctgaggggaattaagcttattcttacctagttgaattcctgccatccacactatgagcattttgaaattgaacttatattttctgggtgaaaataagtcatgaaggtcattcccttatgtaagctcaatgcctgcctgggcacaggggaaaagccacttagttaagtggcctctggtcattcttgtggtgtccactttctttctatgggattgagtaggtggcaggtgttttcaggggaaaccatcctacttgtttccccgaactctttgttgctctgaggacacagctttgctcagaaatgcagcgcagatccttacggctgatgctactctgctctgttctggggaaagcacaatataaagaaagaatttcccagccaggcgcagtggctcacgcctgtaatcccagcactttaggaggccgaggcaggcggatcacttgaggtcaggagtttgagagcagcctggctaacatggtgaaaccctgtttctactaaaaatacaaaaaattaccgggtgtggtggcgcacgcctgtaatcccagctactcgggaggctgcggcaggagaatcgcttgaaccgggaggcagaggttgcagtgagccgagattgtgccattgcactccagcctgggcaacaagagcgaaactccgtctcaaaaaaaaaaagaatttccctcagcaggagatcattttcagctcacgtgtcttgtcattcttttagtgacaatcttacaagaaaactataatgagagaggcattatgtacaaatatgtaagtagtttatttttaataactgcaaaaaaatcctatgtaacaactaccaaaagaaatcctatgaaagagtcctaacaggcattattaccatatcttatgtgattggcatgatagcacctctgataaatcattcagaggtttgccatgccccagcttcttttctcatcataataattgtagttgatactttgcctccaagtccgaggtgctatatagcttttgctaatggtatatttggtgttttgtatagttttgggtagagttgcagaacggagtttatttctatccggtagtcacaaattccttggctctatgaattttccatgaaaggaggaagtaggcttttctcgttgtgggtggtcttttttttttttggagacggagtctcactcagctgcccaggctggagtgtagtggcaccatctccgctcactgcaaccaccatctcctgggttcaagcaattcttccntctcancctcccgagtagctgggattataggcacctgccatcatgcccagctaatttttgtattttagtaaagacgggggttttcaccatgttggccaggctggtcttgaactcctgacttcaggtgatccgcttgccttggcctcctaaagtgctnggattacaggcctgagccaccgcgcccggccccttatgggttcttctacactgctgggatctctgttttaagtgctcagcttcatgattgattgctgggcttccattttcccatccagttctggagttcgtagagagtgaagatggtagacttgaacagataaataaacttaacgatcttgtaagagttgtctagctacttaaaaccctcagaagtaagagcttagtctcacgagttgtaagagtgggatttggagcttggtggtggagactgacttcagctgagagatgcacaacagtcatggttttcttaagcctcttatgaaaccatgaatgagagatgaagctaaagaatagaatccagagatcacaaactcatctagagtacttccacaaaatttacaaagatgtgggaactttatggataggatatattttgtttgttgttgttaatatcaactagaggcactttacatagggttaagtgatcgaacccttttgtggttttgaacaccaacatactggcttacactgctgaaatattttgggtttcattattttgcactggatccaccctgtaaatactcttaagtatacatttcaaccactgttttttctactctttttgctgctcattaaaatctttcatgtaggtgccagaaccatatgtaaacagctttttaaaaaattgaagctggtattttgtttaaacaaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggaaaaacagtatatcaccattgggtagagtggacgggactcatgtaaggactcaatttggggaagagcattcagtggcatgctgttagaggactagtgtccgagaatctcctcacagtatcatgttgcaggaattccccattgctctgcaacttccaaaccagtttgagtcatacaaatgttttctaaacttttattgtattactgcaataaatcttttaacagtaaaaaactcatgtgtatgtctttttcaaactgttcatttgcactgctgcatcgagggtagcaagaatgagattgaaccctggagtactttatacaaattatagaagaagtttgtagaatttttttgccaggtaagaaaaaatgttaatatattttttaaaattatggattatggtggtattaacaatgatctttcccaagctgagaagctggttgcatactttccctaaagacgtgtttttctttggtagccatcatttgatgcatgtgacctacaatgacctggttttgtgcaacagacccctggggcagaaggcctctaggatgcccacgtggaacctgcccagactttcttcaggacaagaggaaaagggaaatgttggaaccactcagatg

SEQ ID NO: 305674 - DNA, 2996 bp, Homo sapiens
tgctctcagcaaaaaaaaaaaaaaaaatatatatatatatatatatacacacaaagaatggaccatttatgtctggtcatggagcatctattaaggaagcactaaaacgtaacagtgctatcatgataaaatcataaatgataaactcgtggattattagtagttttgttggaattaaggttttgtacatggtggttgttttcttactgcagacatggagcagagtaaccctgcctacaccatcagtgctgcgctgtgctatgcaactcagctggtcaacattctgtctcatatacttgatgtaaatcttcccaaaaagctctgcaacagtgaattttgtggcgaaaatctaagcaagcagaaatttactcgagcagtgaagaaactgaatgcaaatattctttacctttgtttttctcagcatgtaaatttagatcaattacaaccactgcataccctcaggaatctaatgtacctggtcagtccaagctctgaacacctaggcaggtcagggccctttgaagtacgagcagaccttgaggagtccatggaatttgtggatcccggagttgctggagaatcagatgagagcggagatgagcgcgtcagcgatgaagaaaccgacctgggcacagactgggagaacttgcctagtccccggttttgtgatatcccttcccagtctgtggaagtctcccagagtcagagcacccaggcgtccccacccatcgcgagcagcagtgcaggtgggatgatctcctctgcagcagcctcggtgacctcctggtttaaagcttacactggacaccgttaacgagcatggaccaaaacataccaaatctgcatcaagaaagttcttctcccactacactctagtaaacattttctgtttaagttaagatagtgtctggaacaaagaggttaaagtgttgttttgttttgtctttttaagcagggagacaaacatttctatttgccaagtggcctgtgatggtgaccaacatgcttatgataattaagagaacaggggtcgaaggtctttctacccagaccagtgctggtggaaggaggacctgtgcgtgtggccagttctgccaaggaagcagttgatttgggttccctctgggcccgggccaccgggcccacagatatgggtcagtgtgctggtccttgcggtgctgagactgttcctgacactttaagttttagaggttggttgaatcacaagaggtgattcttgattattaggacatgaaagataaaagctctttaataagagtttttctgccattgttttttgtatgagaaccagcaggcaatttaaaatttctaatttggtcctttgattttgtttgggaggggtgagttacacgtattttattcatgctgctctgtcgtagtttgtcagacattcctgtttttctttcccccacacaccaaagaaaatgaaagtctttttctttaggacccacatccataaatggaagaaatcctggctgcaataatgtctagagagtttttaactattttcttgtattctgaggggaattaagcttattcttacctagttgaattcctgccatccacactatgagcattttgaaattgaacttatattttctgggtgaaaataagtcatgaaggtcattcccttatgtaagctcaatgcctgcctgggcacaggggaaaagccacttagttaagtggcctctggtcattcttgtggtgtccactttctttctatgggattgagtaggtggcaggtgttttcaggggaaaccatcctacttgtttccccgaactctttgttgctctgaggacacagctttgctcagaaatgcagcgcagatccttacggctgatgctactctgctctgttctggggaaagcacaatataaagaaagaatttcccaccgcgcccggccccttatgggttcttctacactgctgggatctctgttttaagtgctcagcttcatgattgattgctgggcttccattttcccatccagttctggagttcgtagagagtgaagatggtagacttgaacagataaataaacttaacgatcttgtaagagttgtctagctacttaaaaccctcagaagtaagagcttagtctcacgagttgtaagagtgggatttggagcttggtggtggagactgacttcagctgagagatgcacaacagtcatggttttcttaagcctcttatgaaaccatgaatgagagatgaagctaaagaatagaatccagagatcacaaactcatctagagtacttccacaaaatttacaaagatgtgggaactttatggataggatatattttgtttgttgttgttaatatcaactagaggcactttacatagggttaagtgatcgaacccttttgtggttttgaacaccaacatactggcttacactgctgaaatattttgggtttcattattttgcactggatccaccctgtaaatactcttaagtatacatttcaaccactgttttttctactctttttgctgctcattaaaatctttcatgtaggtgccagaaccatatgtaaacagctttttaaaaaattgaagctggtattttgtttaaacaaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggaaaaacagtatatcaccattgggtagagtggacgggactcatgtaaggactcaatttggggaagagcattcagtggcatgctgttagaggactagtgtccgagaatctcctcacagtatcatgttgcaggaattccccattgctctgcaacttccaaaccagtttgagtcatacaaatgttttctaaacttttattgtattactgcaataaatcttttaacagta

SEQ ID NO: 305675 - DNA, 1349 bp, Homo sapiens
gtgactggctctcctctcaggccatcatggcgtctcccagtgggaagggagcccgggcgctggaggctcctggctgcgggccccggccgctcgcccgggacctggtggactccgtggacgatgcggaggggctgtacgtggctgtggagcgctgcccgctgtgcaacactacccgccggcggctgacctgcgccaaatgcgttcagagcggcgatttcgtctacttcgacggccgcgaccgggagaggtttatcgacaagaaggaaaggttaagccgacttaagagcaagcaagaagaatttcagaaagaagtgttaaaagctatggaaggaaaatggataacagatcagttgagatggaaaataatgtcctgcaagatgaggattgaacagttaaaacaaacaatatgtaaaggaaatgaagaaatggagaaaaattctgaaggccttctcaaaaccaaggaaaagaatcagaagctttacagtcgagcacaacggcaccaagagaaaaaggagaagattcagaggcataatcgcaaacttggtgacctggttttcttaagcctcttatgaaaccatgaatgagagatgaagctaaagaatagaatccagagatcacaaactcatctagagtacttccacaaaatttacaaagatgtgggaactttatggataggatatattttgtttgttgttgttaatatcaactagaggcactttacatagggttaagtgatcgaacccttttgtggttttgaacaccaacatactggcttacactgctgaaatattttgggtttcattattttgcactggatccaccctgtaaatactcttaagtatacatttcaaccactgttttttctactctttttgctgctcattaaaatctttcatgtaggtgccagaaccatatgtaaacagctttttaaaaaattgaagctggtattttgtttaaacaaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggaaaaacagtatatcaccattgggtagagtggacgggactcatgtaaggactcaatttggggaagagcattcagtggcatgctgttagaggactagtgtccgagaatctcctcacagtatcatgttgcaggaattccccattgctctgcaacttccaaaccagtttgagtcatacaaatgttttctaaacttttattgtattactgcaataaatcttttaacagta

SEQ ID NO: 305676 - DNA, 299 bp, Homo sapiens
tgctttatgtgtaatatctacttgaactaaactctcaaattttccacttagtgaacattatattattcaggttttgctttcagtttagattgcaagggaaaacacgcatgtttgtggggtggagctctgcagtacacaggaactgtttgcagagataattgttgggtgtgatttatttattttagattctgaaggccttctcaaaaccaaggaaaagaatcagaagctttacagtcgagcacaacggcaccaagagaaaaaggagaagattcagaggcataatcgcaaacttggtgacc

SEQ ID NO: 305677 - DNA, 374 bp, Homo sapiens
cttttcgatgttctagcatgtcttgcagttatattgcatgcccttaaaaaccctctctcttgaaaatccgtgtgtgtcttcctacttgtagagaccccgcagatgtgtcttcagagagtgacagtgccatgacctccagcactgtgagcaagcttgctgaagcccggaggacaacttacctctcaggacgatgggtctgtgacgatcacaacggagacaccagcattagcattacagggccttggattagcctccctaacaatggggactactctgcctactacagctgggtggaggagaagaaaacaacccaggggcctggtgagaagcagcatatcctttgaaatctgtatatagagagagttataggtaaa

SEQ ID NO: 305678 - DNA, 3978 bp, Homo sapiens
  misc_feature (2720)..(2720): n is a, c, g, or t
  misc_feature (2726)..(2726): n is a, c, g, or t
  misc_feature (2877)..(2877): n is a, c, g, or t
ttctttgtataccatttattacttattacactaaataatatccagagtatacatcaagtggctttttgttagaattgtctcattggagtgccgtgtatttacttcgtagacactgcagttctttacaacaggaagtcagacttaggaccagcatgggccatctcagtgaataggtttttttcctatgcacggtcatcaccaatgaagtaggcagacttgtgggaaagtgtggtatcatgattttatttataacttgggtggagattatttgggtaaaggaaaacgcaatcatatgtcaacacggagtgctgcatagacttggggaatgaatggggtgtgcggcgtccctcatcccctcaggtgagggccttcaggaagatggcatattttctggtgttgagaatggttgttatcctaaagagaccctcattgtctgcacacaggtcagggccctttgaagtacgagcagaccttgaggagtccatggaatttgtggatcccggagttgctggagaatcagatgagagcggagatgagcgcgtcagcgatgaagaaaccgacctgggcacagactgggagaacttgcctagtccccggttttgtgatatcccttcccagtctgtggaagtctcccagagtcagagcacccaggcgtccccacccatcgcgagcagcagtgcaggtgggatgatctcctctgcagcagcctcggtgacctcctggtttaaagcttacactggacaccgttaacgagcatggaccaaaacataccaaatctgcatcaagaaagttcttctcccactacactctagtaaacattttctgtttaagttaagatagtgtctggaacaaagaggttaaagtgttgttttgttttgtctttttaagcagggagacaaacatttctatttgccaagtggcctgtgatggtgaccaacatgcttatgataattaagagaacaggggtcgaaggtctttctacccagaccagtgctggtggaaggaggacctgtgcgtgtggccagttctgccaaggaagcagttgatttgggttccctctgggcccgggccaccgggcccacagatatgggtcagtgtgctggtccttgcggtgctgagactgttcctgacactttaagttttagaggttggttgaatcacaagaggtgattcttgattattaggacatgaaagataaaagctctttaataagagtttttctgccattgttttttgtatgagaaccagcaggcaatttaaaatttctaatttggtcctttgattttgtttgggaggggtgagttacacgtattttattcatgctgctctgtcgtagtttgtcagacattcctgtttttctttcccccacacaccaaagaaaatgaaagtctttttctttaggacccacatccataaatggaagaaatcctggctgcaataatgtctagagagtttttaactattttcttgtattctgaggggaattaagcttattcttacctagttgaattcctgccatccacactatgagcattttgaaattgaacttatattttctgggtgaaaataagtcatgaaggtcattcccttatgtaagctcaatgcctgcctgggcacaggggaaaagccacttagttaagtggcctctggtcattcttgtggtgtccactttctttctatgggattgagtaggtggcaggtgttttcaggggaaaccatcctacttgtttccccgaactctttgttgctctgaggacacagctttgctcagaaatgcagcgcagatccttacggctgatgctactctgctctgttctggggaaagcacaatataaagaaagaatttcccagccaggcgcagtggctcacgcctgtaatcccagcactttaggaggccgaggcaggcggatcacttgaggtcaggagtttgagagcagcctggctaacatggtgaaaccctgtttctactaaaaatacaaaaaattaccgggtgtggtggcgcacgcctgtaatcccagctactcgggaggctgcggcaggagaatcgcttgaaccgggaggcagaggttgcagtgagccgagattgtgccattgcactccagcctgggcaacaagagcgaaactccgtctcaaaaaaaaaaagaatttccctcagcaggagatcattttcagctcacgtgtcttgtcattcttttagtgacaatcttacaagaaaactataatgagagaggcattatgtacaaatatgtaagtagtttatttttaataactgcaaaaaaatcctatgtaacaactaccaaaagaaatcctatgaaagagtcctaacaggcattattaccatatcttatgtgattggcatgatagcacctctgataaatcattcagaggtttgccatgccccagcttcttttctcatcataataattgtagttgatactttgcctccaagtccgaggtgctatatagcttttgctaatggtatatttggtgttttgtatagttttgggtagagttgcagaacggagtttatttctatccggtagtcacaaattccttggctctatgaattttccatgaaaggaggaagtaggcttttctcgttgtgggtggtcttttttttttttggagacggagtctcactcagctgcccaggctggagtgtagtggcaccatctccgctcactgcaaccaccatctcctgggttcaagcaattcttccntctcancctcccgagtagctgggattataggcacctgccatcatgcccagctaatttttgtattttagtaaagacgggggttttcaccatgttggccaggctggtcttgaactcctgacttcaggtgatccgcttgccttggcctcctaaagtgctnggattacaggcctgagccaccgcgcccggccccttatgggttcttctacactgctgggatctctgttttaagtgctcagcttcatgattgattgctgggcttccattttcccatccagttctggagttcgtagagagtgaagatggtagacttgaacagataaataaacttaacgatcttgtaagagttgtctagctacttaaaaccctcagaagtaagagcttagtctcacgagttgtaagagtgggatttggagcttggtggtggagactgacttcagctgagagatgcacaacagtcatggttttcttaagcctcttatgaaaccatgaatgagagatgaagctaaagaatagaatccagagatcacaaactcatctagagtacttccacaaaatttacaaagatgtgggaactttatggataggatatattttgtttgttgttgttaatatcaactagaggcactttacatagggttaagtgatcgaacccttttgtggttttgaacaccaacatactggcttacactgctgaaatattttgggtttcattattttgcactggatccaccctgtaaatactcttaagtatacatttcaaccactgttttttctactctttttgctgctcattaaaatctttcatgtaggtgccagaaccatatgtaaacagctttttaaaaaattgaagctggtattttgtttaaacaaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggaaaaacagtatatcaccattgggtagagtggacgggactcatgtaaggactcaatttggggaagagcattcagtggcatgctgttagaggactagtgtccgagaatctcctcacagtatcatgttgcaggaattccccattgctctgcaacttccaaaccagtttgagtcatacaaatgttttctaaacttttattgtattactgcaataaatcttttaacagta

SEQ ID NO: 305679 - DNA, 4042 bp, Homo sapiens
  misc_feature (2784)..(2784): n is a, c, g, or t
  misc_feature (2790)..(2790): n is a, c, g, or t
  misc_feature (2941)..(2941): n is a, c, g, or t
tgctctcagcaaaaaaaaaaaaaaaaatatatatatatatatatatacacacaaagaatggaccatttatgtctggtcatggagcatctattaaggaagcactaaaacgtaacagtgctatcatgataaaatcataaatgataaactcgtggattattagtagttttgttggaattaaggttttgtacatggtggttgttttcttactgcagacatggagcagagtaaccctgcctacaccatcagtgctgcgctgtgctatgcaactcagctggtcaacattctgtctcatatacttgatgtaaatcttcccaaaaagctctgcaacagtgaattttgtggcgaaaatctaagcaagcagaaatttactcgagcagtgaagaaactgaatgcaaatattctttacctttgtttttctcagcatgtaaatttagatcaattacaaccactgcataccctcaggaatctaatgtacctggtcagtccaagctctgaacacctaggcaggtcagggccctttgaagtacgagcagaccttgaggagtccatggaatttgtggatcccggagttgctggagaatcagatgagagcggagatgagcgcgtcagcgatgaagaaaccgacctgggcacagactgggagaacttgcctagtccccggttttgtgatatcccttcccagtctgtggaagtctcccagagtcagagcacccaggcgtccccacccatcgcgagcagcagtgcaggtgggatgatctcctctgcagcagcctcggtgacctcctggtttaaagcttacactggacaccgttaacgagcatggaccaaaacataccaaatctgcatcaagaaagttcttctcccactacactctagtaaacattttctgtttaagttaagatagtgtctggaacaaagaggttaaagtgttgttttgttttgtctttttaagcagggagacaaacatttctatttgccaagtggcctgtgatggtgaccaacatgcttatgataattaagagaacaggggtcgaaggtctttctacccagaccagtgctggtggaaggaggacctgtgcgtgtggccagttctgccaaggaagcagttgatttgggttccctctgggcccgggccaccgggcccacagatatgggtcagtgtgctggtccttgcggtgctgagactgttcctgacactttaagttttagaggttggttgaatcacaagaggtgattcttgattattaggacatgaaagataaaagctctttaataagagtttttctgccattgttttttgtatgagaaccagcaggcaatttaaaatttctaatttggtcctttgattttgtttgggaggggtgagttacacgtattttattcatgctgctctgtcgtagtttgtcagacattcctgtttttctttcccccacacaccaaagaaaatgaaagtctttttctttaggacccacatccataaatggaagaaatcctggctgcaataatgtctagagagtttttaactattttcttgtattctgaggggaattaagcttattcttacctagttgaattcctgccatccacactatgagcattttgaaattgaacttatattttctgggtgaaaataagtcatgaaggtcattcccttatgtaagctcaatgcctgcctgggcacaggggaaaagccacttagttaagtggcctctggtcattcttgtggtgtccactttctttctatgggattgagtaggtggcaggtgttttcaggggaaaccatcctacttgtttccccgaactctttgttgctctgaggacacagctttgctcagaaatgcagcgcagatccttacggctgatgctactctgctctgttctggggaaagcacaatataaagaaagaatttcccagccaggcgcagtggctcacgcctgtaatcccagcactttaggaggccgaggcaggcggatcacttgaggtcaggagtttgagagcagcctggctaacatggtgaaaccctgtttctactaaaaatacaaaaaattaccgggtgtggtggcgcacgcctgtaatcccagctactcgggaggctgcggcaggagaatcgcttgaaccgggaggcagaggttgcagtgagccgagattgtgccattgcactccagcctgggcaacaagagcgaaactccgtctcaaaaaaaaaaagaatttccctcagcaggagatcattttcagctcacgtgtcttgtcattcttttagtgacaatcttacaagaaaactataatgagagaggcattatgtacaaatatgtaagtagtttatttttaataactgcaaaaaaatcctatgtaacaactaccaaaagaaatcctatgaaagagtcctaacaggcattattaccatatcttatgtgattggcatgatagcacctctgataaatcattcagaggtttgccatgccccagcttcttttctcatcataataattgtagttgatactttgcctccaagtccgaggtgctatatagcttttgctaatggtatatttggtgttttgtatagttttgggtagagttgcagaacggagtttatttctatccggtagtcacaaattccttggctctatgaattttccatgaaaggaggaagtaggcttttctcgttgtgggtggtcttttttttttttggagacggagtctcactcagctgcccaggctggagtgtagtggcaccatctccgctcactgcaaccaccatctcctgggttcaagcaattcttccntctcancctcccgagtagctgggattataggcacctgccatcatgcccagctaatttttgtattttagtaaagacgggggttttcaccatgttggccaggctggtcttgaactcctgacttcaggtgatccgcttgccttggcctcctaaagtgctnggattacaggcctgagccaccgcgcccggccccttatgggttcttctacactgctgggatctctgttttaagtgctcagcttcatgattgattgctgggcttccattttcccatccagttctggagttcgtagagagtgaagatggtagacttgaacagataaataaacttaacgatcttgtaagagttgtctagctacttaaaaccctcagaagtaagagcttagtctcacgagttgtaagagtgggatttggagcttggtggtggagactgacttcagctgagagatgcacaacagtcatggttttcttaagcctcttatgaaaccatgaatgagagatgaagctaaagaatagaatccagagatcacaaactcatctagagtacttccacaaaatttacaaagatgtgggaactttatggataggatatattttgtttgttgttgttaatatcaactagaggcactttacatagggttaagtgatcgaacccttttgtggttttgaacaccaacatactggcttacactgctgaaatattttgggtttcattattttgcactggatccaccctgtaaatactcttaagtatacatttcaaccactgttttttctactctttttgctgctcattaaaatctttcatgtaggtgccagaaccatatgtaaacagctttttaaaaaattgaagctggtattttgtttaaacaaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggaaaaacagtatatcaccattgggtagagtggacgggactcatgtaaggactcaatttggggaagagcattcagtggcatgctgttagaggactagtgtccgagaatctcctcacagtatcatgttgcaggaattccccattgctctgcaacttccaaaccagtttgagtcatacaaatgttttctaaacttttattgtattactgcaataaatcttttaacagta

SEQ ID NO: 305680 - DNA, 1545 bp, Homo sapiens
attgataagggtccgtgtcgactttgaggtcaggacagaaatactgaatgactttacacttaggaaaaaatagctaaataattaagatgcaggctgtagtgttcaaaccaatagagcagggaaagggaaatgtagatactttattaattcagtggaagataggaaagttagaagcaaaggaggctgggcacagtggctcatgcctgtaatcctagcactttgggaggccaagacaggtggatcacctgaggttaggggtttcaccatgttggccaggatggtcttgatctcctaacctcttgatctgccctccttggcctcccaaagtgctgcgattacaggcgtgagccaccgcactggcctaatttctcttttctctgcattgaactagaaaaacatcgttctctttttcgtaatgttccatagttacaaaagctataacataaggtctttttcttcattatgttttctgacatatctgaaaataagcagtgatcccaggtagataatcatattaaccataagagaccaacgtttgtgatatttattacatgcttttttcagagatggaaaataatgtcctgcaagatgaggattgaacagttaaaacaaacaatatgtaaaggaaatgaagaaatggagaaaaattctgaaggccttctcaaaaccaaggaaaagaatcagaagctttacagtcgagcacaacggcaccaagagaaaaaggagaagattcagaggcataatcgcaaacttggtgacctggtagaaaaaaagaccattgacttaagaagtcattatgagcgtctggcaaatcttcgacgatcccatatattagagctcacctctgtcatttttccaatcgaggaagtaaagacgggtgtgagagaccccgcagatgtgtcttcagagagtgacagtgccatgacctccagcactgtgagcaagcttgctgaagcccggaggacaacttacctctcaggacgatgggtctgtgacgatcacaacggagacaccagcattagcattacagggccttggattagcctccctaacaatggggactactctgcctactacagctgggtggaggagaagaaaacaacccaggggcctggtgagaagcagcatatcctttgaaatctgtatatagagagagttataggtaaaattgacataacaaaatgaagagctttcaagtgaaccattcaggggcatttagtacattcacagcactgtgctcccatcacctccatgtcatttcaaaacattttgatcaccccagacagaaaccccatggcatgaaagtgtcacatttccccactctcccttcccctcagctcctgggcaaccacacattgctttctgtgtctatagatttgcctgttctgggcagcttatataaatggaatcacagaacatatagctttttgtgtcagacttctttcacttagcgtaatgttttcaagattcatccacatgatagtatatattagtgtttcattcgtttttatggttgagtaatattccatcatatggataagacac

SEQ ID NO: 305681 - DNA, 2804 bp, Homo sapiens
gtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtcatggaaaagcccagtgacctgaccagcacctgcgagaggtccctgcttacctgacggacgtcctgctggcacctcagacaatccactctcaggaggcgcagcccgaagcccagtttcccttctatgcagtattgccacaatgcctctcccacgatgtcaaggactcctgtctgtcctggaggtgggagacaaggaacctccgaagaggaagcaagaaagccgtactgtctatgttgtgatccttcatcgaacaaactgatgcgaaaacttgaatctgttactgaaatgaggagagaaggacatgtgctattgaactgagccaaacacactgtaaatatccacagactccctcccctgcccccatcccaaatgatcttgagatttcttttaaagaagtaaatttgtccaatggctgtaaactataaactactgtaattaagtgcaatttcccctctgtgtcctctcccctctgccctgtatataatactaaagtgtctattagttttctttgtaaaggtcagagtcaaaatttcaaaagtgatctgtcccctctcccctcatggagaaacatcctaagtgggaagtgaagccccttgtcctctcccgcgggcctggacacttatggggacagcataccttggactgactaccagctaactccagtctcctgacattaagacacacctctggatccctggaggggctgaatgtagtgtgtcagagtaacatgccagcttcctgtgggccaggagctcagccgtgcactccctaagaaaccccagggcagggaaactggctgtttgatagcagaagaaaaagttgcagtctcagaaagccttccattaaaacaatttattttat

SEQ ID NO: 305682 - DNA, 1884 bp, Homo sapiens
gaatccatccagtcattcatttattcatcagaagtttaccgagtggctattcagtgccaaggcactggggatacatcagtgaacaaaacaaacgagataaaaatttcctgccctcgtggcgcttacattctagaattaaatagagaacatgccatatttaccctggagaaaagcagccgatatttcttgtgggtggacaggggaggagaaagcaactttattttcttattacccacccttgaaaacaagaggtgccgagtcattgttccaggaccctggtggcactaatgttccctactgggtttgtgttgttttgcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtcatggaaaagcccagtgacctgaccagcacctgcgagaggtccctgcttacctgacggacgtcctgctggcacctcagacaatccactctcaggaggcgcagcccgaagcccagtttcccttctatgcagtattgccacaatgcctctcccacgatgtcaaggactcctgtctgtcctggaggtgggagacaaggaacctccgaagaggaagcaagaaagccgtactgtctatgttgtgatccttcatcgaacaaactgatgcgaaaacttgaatctgttactgaaatgaggagagaaggacatgtgctattgaactgagccaaacacactgtaaatatccacagactccctcccctgcccccatcccaaatgatcttgagatttcttttaaagaagtaaatttgtccaatggctgtaaactataaactactgtaattaagtgcaatttcccctctgtgtcctctcccctctgccctgtatataatactaaagtgtctattagttttctttgtaaaggtcagagtcaaaatttcaaaagtgatctgtcccctctcccctcatggagaaacatcctaagtgggaagtgaagccccttgtcctctcccgcgggcctggacacttatggggacagcataccttggactgactaccagctaactccagtctcctgacattaagacacacctctggatccctggaggggctgaatgtagtgtgtcagagtaacatgccagcttcctgtgggccaggagctcagccgtgcactccctaagaaaccccagggcagggaaactggctgtttgatagcagaagaaaaagttgcagtctcagaaagccttccattaaaacaatttattttat

SEQ ID NO: 305683 - DNA, 3035 bp, Homo sapiens
gtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggagtgcgctacagccagcagggaaacaatgagatcacttcctcctcaacaatcagtcaccatggcaacagcgccatggtgaccagccagtcggttttacagcaagtctccccagccagcctggacccaggccacaatctcctctcacctgatggtaaaatgatctcagtctcaggaggaggtttgcccccagtcagcaccttgacgaatatccacagcctctcccaccataatccccagcaatctcaaaacctcatcatgacacccctctctggagtcatggcaattgcacaaagcctcaacacctcccaagcacagagtgtccctgtcatcaacagtgtggccggcagcctggcagccctgcagcccgtccagttctcccagcagctgcacagccctcaccagcagcccctcatgcagcagagcccaggcagccacatggcccagcagcccttcatggcagctgtgactcagctgcagaactcacacatgtacgcacacaagcaggaacccccccagtattcccacacctcccggtttccatctgcaatggtggtcacagataccagcagcatcagtacactcaccaacatgtcttcaagtaaacagtgtcctctacaagcctggtgatgcccacacaccacttacttcgtgcgcaacaacaaggaccctgttttccacaccatcaccctctgggcagctgtcatggaaaagcccagtgacctgaccagcacctgcgagaggtccctgcttacctgacggacgtcctgctggcacctcagacaatccactctcaggaggcgcagcccgaagcccagtttcccttctatgcagtattgccacaatgcctctcccacgatgtcaaggactcctgtctgtcctggaggtgggagacaaggaacctccgaagaggaagcaagaaagccgtactgtctatgttgtgatccttcatcgaacaaactgatgcgaaaacttgaatctgttactgaaatgaggagagaaggacatgtgctattgaactgagccaaacacactgtaaatatccacagactccctcccctgcccccatcccaaatgatcttgagatttcttttaaagaagtaaatttgtccaatggctgtaaactataaactactgtaattaagtgcaatttcccctctgtgtcctctcccctctgccctgtatataatactaaagtgtctattagttttctttgtaaaggtcagagtcaaaatttcaaaagtgatctgtcccctctcccctcatggagaaacatcctaagtgggaagtgaagccccttgtcctctcccgcgggcctggacacttatggggacagcataccttggactgactaccagctaactccagtctcctgacattaagacacacctctggatccctggaggggctgaatgtagtgtgtcagagtaacatgccagcttcctgtgggccaggagctcagccgtgcactccctaagaaaccccagggcagggaaactggctgtttgatagcagaagaaaaagttgcagtctcagaaagccttccattaaaacaatttattttatcactacccagagtctcatatttctgtctctgatactttccctgccatggttccaccgagaacccctggcccctggtctccttggaattttctgtatactccactgggatcctgtagtgtgtcatctaggggtgtagagaggtgggtggccttctcttgccgtcatgctcccagtgtctgtgtaggctttactgctgattgaggtgaagaagagttgaatcccccagtaaga

SEQ ID NO: 305684 - DNA, 4184 bp, Homo sapiens
gtggcgatcatggcaagttagaagttttctgactcctttcggaggagcctccgggaccccggggagtaacaggtgtctggaggctgaagggtggaggggttcctggatttggggtttgcttgtgaaactcccctccaccctcctctctcgcacccacccaccccctcacccccttctttttccgtccttggaaaatggtgtccaagctcacgtcgctccagcaagaactcctgagcgccctgctgagctccggggtcaccaaggaggtgctggttcaggccttggaggagttgctgccatccccgaacttcggggtgaagctggagacgctgcccctgtcccctggcagcggggccgagcccgacaccaagccggtcttccatactctcaccaacggccacgccaagggccgcttgtccggcgacgagggctccgaggacggcgacgactatgacacacctcccatcctcaaggagctgcaggcgctcaacaccgaggaggcggcggagcagcgggcggaggtggaccggatgctcagtgaggacccttggagggctgctaaaatgatcaagggttacatgcagcaacacaacatcccccagagggaggtggtcgatgtcaccggcctgaaccagtcgcacctctcccagcatctcaacaagggcacccctatgaagacccagaagcgtgccgctctgtacacctggtacgtcagaaagcaacgagagatcctccgacaattcaaccagacagtccagagttctggaaatatgacagacaaaagcagtcaggatcagctgctgtttctctttccagagttcagtcaacagagccatgggcctgggcagtccgatgatgcctgctctgagcccaccaacaagaagatgcgccgcaaccggttcaaatgggggcccgcgtcccagcaaatcttgtaccaggcctacgatcggcaaaagaaccccagcaaggaagagagagaggccttagtggaggaatgcaacagggcagaatgtttgcagcgaggggtgtccccctccaaagcccacggcctgggctccaacttggtcactgaggtccgtgtctacaactggtttgcaaaccgcaggaaggaggaggcattccggcaaaagctggccatggacgcctatagctccaaccagactcacagcctgaaccctctgctctcccacggctccccccaccaccagcccagctcctctcctccaaacaagctgtcaggtaagcaaaggttgggcctcactgcctcggcaacccaaccatcctggttcttgccacggatcttatctggtttaagggttttcagaggagcaaacgcttttgagatgatcctagggccgctctctcattgccagaatatactcccctggaaataatgtgtggctctgatcagtttcctccaactcctggttcagccattgccctgtgagggctcactcggcttccagggagccctttaccctatttgtctccttccctcttcttctccctgtgtggctgctgactcagcggtcattctacactgaggaggctgccttatgggtgggccagatccaaaccgcaggcaaacgggtcgtgatggcgtggcaaccctcactgtgttggaggatggcactccggccacctcctccatctctggccatatcctgcccctcgctcggtccggctgcctcaggagaagctcagtagcctttggggacggccactctgttggtggcctctgcttgttggcttccgtgtgtcatcagggttggtgggggtcagtcacttgaaatctttgcagcaatgagttgggaaaaactgaccgagtacctgctccatcatgcttgattgagtgctcctgtgtgctggccctggcctggattagaatgcctctgctgtgggctttgggtttgtcaggatggaatcctacgacctcctcgggggaaagcacacctcatgctgagcgctctcttaggcacaggctgggatggagcacttcttctggtccttcattcttctggcaaagctggcttctagaatggatgtgctcactggggtctgtgtggtgcccatgaccacaaagtgtagcagcctcctgcctgctccaagaaaagggcttgtgaaaggaaagccaaacactgtttctaactcaggggtgattctgaaacctgttggctcccctcacctgtcggttgccttctgatgagaaaggcctgagggctgggggctgacccaagtgttgaggggaccaaagccaccaagacaggctcggagccatcagctgggtggtgtacaagcatttgttccatccctgctgtgccctcccatagcactgcctctttccaggggcctctgggagcctgacagtgcccagcatgaaggtggggccagtgctgggggtttctgtaggtccactcccacagaggagagaggctcagccacacaggaagaaagtcttggttacttaagaggcagagaagccctaggcaaagactggcctgattgcagagtaacttcgcccctttaggaaattcaaagcagggttctgaggcaaatggcacatggctggcactgagcagtaccagtgtgcttgcccaccacagcgatccacggagctgaagctgggagctacagggggcgtggttggggcaaggggcattactgggaagacaatggccattgtgttgggacctgtgatctccacaccaaagtcagggagcctggaagccaaacaaaggcccagcagccttctgacaagcaagggctgtgctgaggtcaccacggggtcgttggtttaggcatcctgtgtgctgacaggagacccagagagctagggctggagggacagggagcagggcagaaaacacagcctgtgtactcctctgactggagtctaggaagggcgtgtcatgggaagcggatactcgggtgctcaagtctgatctttctaaaatcttgtaatgttagaatttggaggaatttgaagaaggaactgaggcccagaaagaggcagtgatttgccaaagtgacacagagcaatggtacgaaaacaaggactagagctctggcctgctggttcccactccatactttcccacagcactacgatgtgttgaatgcttaccaagtcctgggatatgctagtgatgtacgagctgcgcgtcctgcctctgggaggttactgtctggtaggaaggatatcgggtcactgtcgagtccccagaaccagctgcagatggaggttttgtttgggggctttgtggatctttctgcggtgtaataagatcctatactgtttctggagcaacagttatgggacactgatattatcagtggctgcctttcttctgtcttttttttttttttttttttttgagagacagggtctacctctgtcacccgagctagagtgcagtggtgcagtcttggctcactacagcctcgaactcctggtctcaagcagtcctcctgtcttagcctcccaaagtgctgggattacagttgtgagattgtgcccagcccttctgctttaattttcactctgggctcctcaacatggtccttgtcccaagcccagggactggcttctctttctctgagtgtagttatgtatctgggttctaaccagtaaggttataactgtggctaattcacataacttctctgagtctgaatttcctgcctacaaaatggagaaataggaccttccacacagggtgcatgtgaggatgaaaggagtgaatgtataaagacacctttcccgataacccatactaccctcattatgactcttaacattagagagggctaaacaagggcagtgagaagactggcaggcagcagaaatcattttctttttgatctcacacaccagggcattccccgtaagaggcagtgagatgtagcctggccctggaactagaaacagaggtggctgctgtgctagtgcctgagatgcacgatgctggggtcaaagacttgtgtccccacctcaggctgccaggatggcgtgtgtgccgtgacagggctcccgagtcatgcactcaggcagacagcaggctggagcccagcattcaggggtggcttctgtctgtagagccgcatggcactcttcccacctcagtgcccacagccaaggtagggtcactaaccaagccagaaacgtaactgtgtgcagaataccg

SEQ ID NO: 305685 - DNA, 2445 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctacca

SEQ ID NO: 305686 - DNA, 512 bp, Homo sapiens
ttcggcacgagcggcacgaggttaagaagctctacggggctatcagccatggcgtggtggatgtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctacca

SEQ ID NO: 305687 - DNA, 2047 bp, Homo sapiens
  misc_feature (1996)..(1996): n is a, c, g, or t
  misc_feature (2038)..(2038): n is a, c, g, or t
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggagnggacccattcttaccttgaggagcaaaagttcggaactgggnggacggttt

SEQ ID NO: 305688 - DNA, 794 bp, Homo sapiens
cctgggtgacagagtgagactctgtctaaagaaaaaaaaaaagaatgagatcagacttgggggtagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctacca

SEQ ID NO: 305689 - DNA, 406 bp, Homo sapiens
tccagaactacatctcccataatgccaggcagcagcggtggctaaactgggtgcatgatggtctccagtgcactctaggaaatgtggttctctaggtagaaaaggcgacctggaggtgggctgcagactgacctcctgatccctggtcttgcagtcactcccaccccgaggcccacagacggtgtggatatttactttggcatgcctggggaaatcagtgagcacgaggggttcctgagggccaagatggacctggaggagcgtaggatgcgccagattaatgaggtgataatactgggggccccaggaccccctacagtacagagctccctaaataccaggaaattcctccaggacacattgatactacctccaaaggctccctaagcccctttgaccttgagct

SEQ ID NO: 305690 - DNA, 440 bp, Homo sapiens
gctgggggcttggattccttgtcctgagggaagagggagctgaggacgtggaattgagatcctagaaaatgagagggctgggggacgctctcttgggcccttgggtaggaagaagccagtgccaggcttctgggttcctgacacctcctgctcccccaggtgaatgcgtctgttccaaggggtttccctttccactcatcggagattcagagggatgagctggtaagaggaggaacagccgggtacctaggggaagagaccagaggtcagcggccaggctgtgattcccaaagccacacaggaccctcaaagaagccctctgccccatctcctctccctgcaggcaccagctgggacaggggtgtcccgtgaggctgtgtcgggtctgctgatcatgggagcgggcggaggctccctcatcgtcctctccatgctgctcc

SEQ ID NO: 305691 - DNA, 423 bp, Homo sapiens
agcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctac

SEQ ID NO: 305692 - DNA, 2421 bp, Homo sapiens
cgcggggcggggctggcggcgccggcgcagcccgggggcggcgggaggaggaggtggcggcggtggcgctgggagctcctgtcaccgctggggccgggccgggcgggagtgcaggggacgtgagggcgcaagggccgggacatggggcccgccagccccgctgctcgcggtctaagtcgccgcccgggccagccgccgctgccgctgctgctgccactattgctgctgcttctgcgcgcgcagcccgccatcgggagcctggccggtgggagccccggcgcggccgaggccccggggtcggcccaggtggctggactatgcgggcgcctaacccttcaccgggacctgcgcaccggccgctgggaaccagacccacagcgctctcgacgctgtctccgggacccgcagcgcgtgctggagtactgcagacagatgtacccggagctgcagattgcacgtgtggagcaggctacgcaggccatccccatggagcgctggtgcgggggttcccggagcggcagctgcgcccacccccaccaccaggttgtgcccttccgctgcctgcctggtgaatttgtgagtgaggccctgctggtgcctgaaggctgccggttcttgcaccaggagcgcatggaccaatgtgagagttcaacccggaggcatcaggaggcacaggaggcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctacca

SEQ ID NO: 305693 - DNA, 2050 bp, Homo sapiens
tcggcaccttccaaggaggcatcacagaggcggggcgggcagacgctgctaggcgcgggcgctgcgggacctggaggtacagaatgccgtgttggtgagcccctcgctgagtggccactatgccctgcccttctctgatgcgaggccaccaccagctacctggatttgtgcccatcgcacccagctccacccagaattatacccaggagcaattctgggctgtgaagactccaacccttatcctgtatggagagctggaacacatcctggctcgagagtcactgcctgcagctcccagggcctcatcctgcacggctcgggcatgctcttaccctgtggctcggatcggttccgtggtgtggagtatgtgtgctgtccccctccagggacccccgacccatctgggacagcagttggtgacccctccacccggtcctggcccccggggagcagagtagagggggctgaggacgaggaagaggaggaatccttcccacagccagtagatgattacttcgtggagcctccgcaggctgaagaggaagaggaaacggtcccacccccaagctcccatacacttgcagtggtcggcaaagtcactcccaccccgaggcccacagacggtgtggatatttactttggcatgcctggggaaatcagtgagcacgaggggttcctgagggccaagatggacctggaggagcgtaggatgcgccagattaatgaggtgatgcgtgaatgggccatggcagacaaccagtccaagaacctgcctaaagccgacagacaggccctgaatgagcacttccagtccattctgcagactctggaggagcaggtgtctggtgagcgacagcgcctggtggaaacccacgccacccgcgtcatcgcccttatcaacgaccagcgccgggctgccttggagggcttcctggcagccctgcaggcagatccgcctcaggcggagcgtgtcctgttggccctgcggcgctacctgcgtgcggagcagaaggaacagaggcacacgctgcgccactaccagcatgtggccgccgtggatcccgagaaggcacagcagatgcgcttccaggtgcatacccaccttcaagtgattgaggagagggtgaatcagagcctgggcctgcttgaccagaacccccacctggctcaggagctgcggccccaaatccaggaactcctccactctgaacacctgggtcccagtgaattggaagcccctgcccctgggggcagcagcgaggacaagggtgggctgcagcctccagattccaaggatgacacccccatgacccttccaaaagggtccacagaacaagatgctgcatcccctgagaaagagaagatgaacccgctggaacagtatgagcgaaaggtgaatgcgtctgttccaaggggtttccctttccactcatcggagattcagagggatgagctggcaccagctgggacaggggtgtcccgtgaggctgtgtcgggtctgctgatcatgggagcgggcggaggctccctcatcgtcctctccatgctgctcctgcgcaggaagaagccctacggggctatcagccatggcgtggtggaggtggaccccatgctgaccctggaggagcagcagctccgcgaactgcagcggcacggctatgagaaccccacttaccgcttcctggaggaacgaccctgacccggcccccttcaccccttcagccgagcccagacctcccctcttcctggagccccagaaccccaactcccagcctagggcagcagggagtcttgaagtgatcatttcacacccttttgtgagacggctggaaattcttatttcccctttccaattccaaaattccatccctaagaattcccagatagtcccagcagcctccccacgtggcacctcctcaccttaatttattttttaagtttatttatggctctttaaggtgaccgccaccttggtcctagtgtctattccctggaattcaccctctcatgtttccctactaacatcccaataaagtcctcttccctacca

SEQ ID NO: 305694 - DNA, 2583 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaaggtaatcatggcaccagtcttcgtgggccagtctactgggaaggagaccactgtctcgggggctcaagttcctgtgggcaggctcagttgcccccgaatgggatcattcctcacgcttcaggcacacacactccatctcagtagggatctagccacatcccccaggactagtaacagaggtcacaaagtggaggtgagctgggaacagagggctgcagggatgggtggtgctggtctgtaataagctttgagagcaacgtcactggggctttggggtcagctacacaaggaaggcatttggacccctgccttttcattgcccgaaaccagagcctttccaccaagcgtttcccagtcttagccctgtgtcctgagttacgtacgatctttctggcaaatggggtgcatgataagagcatctcttacgaagagttggaaaaacaaatgccatatataaattctaagccatatgaggacgaggagtaatggcattttcttcctttttcctctcactcccagacattcattgtccctgaatgctccattaatccagggaaggtaattgcctaaatctccagtggatctcgcaacaggaaggaaccagaagctgggaaagttgtttacctctttgtcccagagttagacctcatcctcccctagcttagctgtctcagagatatactggccctcccttctcttctctttgctgctggtgctaaaactgctctgtaggtcattggccactgtctccactcacaacccctgctccagtcctggagggagtgggttaaacacaaatagaacattccatttgaagcagtgattctttttttttttttttttttttaatcaaatgctttggacttttgaagtccacttgttctgtacttgtaaaagggaaagaaggccgggcgcagtcgtcacgcctgtaatcccagcactttagatcacttgaggtcaggagtttgagaccagcccggccaacatggtgaaaccccatctctactaaaaatacaaaaattagctgtgcatagtggttggcacctgtagtcccagctactcaggaggctgaggcaagctaactgcttgaacccagaaggcagaggttgcagtgagctgagatcacgccactgcactccagcctgggtgacagagtgagtgagactctgcgtt

SEQ ID NO: 305695 - DNA, 693 bp, Homo sapiens
  misc_feature (18)..(18): n is a, c, g, or t
  misc_feature (34)..(34): n is a, c, g, or t
  misc_feature (40)..(40): n is a, c, g, or t
  misc_feature (43)..(43): n is a, c, g, or t
  misc_feature (45)..(45): n is a, c, g, or t
  misc_feature (58)..(58): n is a, c, g, or t
  misc_feature (65)..(65): n is a, c, g, or t
  misc_feature (68)..(68): n is a, c, g, or t
  misc_feature (71)..(71): n is a, c, g, or t
  misc_feature (393)..(393): n is a, c, g, or t
  misc_feature (398)..(398): n is a, c, g, or t
  misc_feature (402)..(402): n is a, c, g, or t
cctctaacgggtcctggntttacatggaggtttnttggtnagngncacccccattggnggcaganggnccnccacctcagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcaaaaaaaaaaaaaaaaaanaaaanaaanaaaaaaaaaaaaaaaaaaagaaaaaaaaaaaaaacaacaaacaaaagcacacaacgaaagctacagtaaccaacaccaacacaaccagagactcaaaacagaggtgccaactccttcacgctcgacgatgacacacatacccgccccgctagccaagcgagtcctcacgcaccccagacgaacactatagccgagcggcgacgtctaccaccaaacatagagactcaaagcagacaggaaacacagcaagcaacgttctgcagctgaggccaaacaccaatcacagcaact

SEQ ID NO: 305696 - DNA, 998 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagagatgaggtctcactttgttgctcaggctgatctctaacccctggactcaaacaatcctctcacctcagcctcccgaagtattggagttaagagatgtgagccactgtgcccggccaatttttaaatttgtaattgatgcataatggttatgtataatcgtcggg

SEQ ID NO: 305697 - DNA, 3919 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcaaaaaaaagatcacgaaagtcagagagaccacacaaacacacaagtgtgggcagcccgcttcagcgaagtacagcgg

SEQ ID NO: 305698 - DNA, 5439 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305699 - DNA, 3843 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttca

SEQ ID NO: 305700 - DNA, 4188 bp, Homo sapiens
  misc_feature (3861)..(3861): n is a, c, g, or t
  misc_feature (3866)..(3866): n is a, c, g, or t
  misc_feature (3870)..(3870): n is a, c, g, or t
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcaaaaaaaaaaaaaaaaaanaaaanaaanaaaaaaaaaaaaaaaaaaagggggggggggctaaaaatttccccggggggggcccaattttgggtgtcccggttttttgggaaaagggggggcccatattgggaggcgtggatattatagactgaaggcgtggggcgcgggtgtgtttaaaaaagttgtgaagcggggaaaccactggtgactgtgggaatgtggggagagggaacccctacttggtgggggggcaatactggggacaactcccttgagaggatttaaggctcagggagcaactataactttgagggttaataggggttcagccagcgtatttagctc

SEQ ID NO: 305701 - DNA, 6598 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagaaagtagatgggggatttgcacactcagcaccacctctctctctgggcctctaatgccctgccctctccattgtccctaatttatagctttgggccttattttctggcttctgggcaaggcacagaggaatatcatgaactaagtgctctagagtctgtttcaagctagtgtagcccgtgaatttcctgcaccctccatatcacactgcaagtcctccggactcctgggacatggattgggaggaagtcctatttggacagaatgtgcagccaatagcatgaatttgaactgtccccaagggctgcttagaagtgcagagatgcagggtagagaagagaactgtttgtattagtccattttcacactgctgagaaagacatacccaagaccgggcaatttacaaaagaaagaggtttaatggactcacagttccacgtggctggggaggcctcacaattgcagaaggcaaaaggcacgtctcacatggcggcagacgagaagagagcttgtacagggaaactcccctttataaaatcatcagatctcgtgagatttattcactatcacaagaacagcacagggaagacctgcccccatgagtcaatgacctcctaccaggtccctcccataacacgtgggaattcaagatgagatttgggtggggacacagccaaaccatctcagccataccatacccttgtcccctgtgtgcccacccttccccacgggaggaaatggtacagatggcacaggtgtgtgcaagaatgaccgttccctcagaagcctgtgctcattctggaaggtgctttgggagttaggaatccataagctaaggcaaagtatttgcaaagagtcaggagaacagagttgttactgcaatgatcagttataaaatgtcaagctggaagaggtgcatttggtctgcttattttaaaggtgagtgaagtccagaaaggccagcttgtggcagaaataggtcagtcctagaagttgggcctcctggcctaccatggtctttggaccactctgtgttgaggaaagaacatcagatacacagacatgtgcctctgccattgttgggaagccctgactaagaatgggaaggagtcaccccgtcccccttccttgctctagggtgaccccacacttccttgcaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305702 - DNA, 5567 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtaagcccgaggagatgtcggaggccctgagccaggccttggggcaagagtgggcttgaggggcagggggctagactagagagtatccatctccaggagacgtccctgaccttacagtcctgccgcaggtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305703 - DNA, 5399 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305704 - DNA, 6474 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaagagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagaaagtagatgggggatttgcacactcagcaccacctctctctctgggcctctaatgccctgccctctccattgtccctaatttatagctttgggccttattttctggcttctgggcaaggcacagaggaatatcatgaactaagtgctctagagtctgtttcaagctagtgtagcccgtgaatttcctgcaccctccatatcacactgcaagtcctccggactcctgggacatggattgggaggaagtcctatttggacagaatgtgcagccaatagcatgaatttgaactgtccccaagggctgcttagaagtgcagagatgcagggtagagaagagaactgtttgtattagtccattttcacactgctgagaaagacatacccaagaccgggcaatttacaaaagaaagaggtttaatggactcacagttccacgtggctggggaggcctcacaattgcagaaggcaaaaggcacgtctcacatggcggcagacgagaagagagcttgtacagggaaactcccctttataaaatcatcagatctcgtgagatttattcactatcacaagaacagcacagggaagacctgcccccatgagtcaatgacctcctaccaggtccctcccataacacgtgggaattcaagatgagatttgggtggggacacagccaaaccatctcagccataccatacccttgtcccctgtgtgcccacccttccccacgggaggaaatggtacagatggcacaggtgtgtgcaagaatgaccgttccctcagaagcctgtgctcattctggaaggtgctttgggagttaggaatccataagctaaggcaaagtatttgcaaagagtcaggagaacagagttgttactgcaatgatcagttataaaatgtcaagctggaagaggtgcatttggtctgcttattttaaaggtgagtgaagtccagaaaggccagcttgtggcagaaataggtcagtcctagaagttgggcctcctggcctaccatggtctttggaccactctgtgttgaggaaagaacatcagatacacagacatgtgcctctgccattgttgggaagccctgactaagaatgggaaggagtcaccccgtcccccttccttgctctagggtgaccccacacttccttgcaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305705 - DNA, 3907 bp, Homo sapiens
ttggctaggtagaggcgcgggttaccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305706 - DNA, 3824 bp, Homo sapiens
  misc_feature (26)..(26): n is a, c, g, or t
ctttgctgcccgtttcgactctagangatccccgagtgggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305707 - DNA, 5067 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305708 - DNA, 3590 bp, Homo sapiens
actctagaggatctcaaacgacccgaagacctcgcttgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305709 - DNA, 3799 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttca

SEQ ID NO: 305710 - DNA, 4891 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305711 - DNA, 3162 bp, Homo sapiens
cctatttccaattgaagctactatcatgggcgtttagagttatacaaatgacacttacaaaaaataaaagaccaagacacccaggcagtacgcccgtcgggcgtactgccgggctatgcaatatgcagacatgaaagaaatgctacgggcgtctgcactgaggaaggaggaagggaggagcgcttgctgtgatgagaagcctggagctggcagagaatgttagaagagggaaagcaaaggttcggggggcagagcagtgtggcagaagttctatgagacaagtcggggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacaccccttccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgatttaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305712 - DNA, 3295 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttca

SEQ ID NO: 305713 - DNA, 3903 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtgggtgccggccagactggctttccctgcccagcggggagaagatctgagctggggtatcagtcccaaggcctctctcagccacagctagggaagggggttaagagaggctgctttggcagaggtttaaaatgtgttatctcgggatctgggctccgctcattggtgttcattcaggaatacagatacctagattcacacacgtggtgtgttaacagaggcagctgagtaattatggtctaagagcgctcaggctgggtgcagtggctcatgcctgtaatcccagcaatttgggaggccgaggcaggaagatcacttgagatcaggagttcgagaccagtctggtcaaaatggtgaaaccccatctctactaaaaaatacaaaagttagccaggcatggtcacgcatgcctataatcccagctactcaggaggctgacgcataagacttgcttgaacccgggaggtggaggttgcagtgagccaagatcacgccattgtactccagcttgggagatactcccgctgtctcaaaaataaaataaataaataggccaggcacagtggctcacgcctgtaatcccagcaccttgggagggtgaggcgggtggatcacttgaggtcaggagttggagaccagcctggccaacaggtgaaaccccatctctactaaaaatacaaaaagtagccgggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagag

SEQ ID NO: 305714 - DNA, 3121 bp, Homo sapiens
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagaaagtagatgggggatttgcacactcagcaccacctctctctctgggcctctaatgccctgccctctccattgtccctaatttatagctttgggccttattttctggcttctgggcaaggcacagaggaatatcatgaactaagtgctctagagtctgtttcaagctagtgtagcccgtgaatttcctgcaccctccatatcacactgcaagtcctccggactcctgggacatggattgggaggaagtcctatttggacagaatgtgcagccaatagcatgaatttgaactgtccccaagggctgcttagaagtgcagagatgcagggtagagaagagaactgtttgtattagtccattttcacactgctgagaaagacatacccaagaccgggcaatttacaaaagaaagaggtttaatggactcacagttccacgtggctggggaggcctcacaattgcagaaggcaaaaggcacgtctcacatggcggcagacgagaagagagcttgtacagggaaactcccctttataaaatcatcagatctcgtgagatttattcactatcacaagaacagcacagggaagacctgcccccatgagtcaatgacctcctaccaggtccctcccataacacgtgggaattcaagatgagatttgggtggggacacagccaaaccatctcagccataccatacccttgtcccctgtgtgcccacccttccccacgggaggaaatggtacagatggcacaggtgtgtgcaagaatgaccgttccctcagaagcctgtgctcattctggaaggtgctttgggagttaggaatccataagctaaggcaaagtatttgcaaagagtcaggagaacagagttgttactgcaatgatcagttataaaatgtcaagctggaagaggtgcatttggtctgcttattttaaaggtgagtgaagtccagaaaggccagcttgtggcagaaataggtcagtcctagaagttgggcctcctggcctaccatggtctttggaccactctgtgttgaggaaagaacatcagatacacagacatgtgcctctgccattgttgggaagccctgactaagaatgggaaggagtcaccccgtcccccttccttgctctagggtgaccccacacttccttgcaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttagcaaacacctgggagaggctgctttggcacacaatatgagggtacca

SEQ ID NO: 305715 - DNA, 1889 bp, Homo sapiens
  misc_feature (1807)..(1807): n is a, c, g, or t
  misc_feature (1839)..(1840): n is a, c, g, or t
  misc_feature (1870)..(1870): n is a, c, g, or t
  misc_feature (1873)..(1873): n is a, c, g, or t
gcatagcgctcggagcctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacaagtttcctggctgactccaagtgcaatccaatgaaactcctggggggnttccttctgggtttccgggccaatcaacgggnntctcctccaagtgggggactccccatcctnacnaaggggtccccctgaa

SEQ ID NO: 305716 - DNA, 407 bp, Homo sapiens
atttcccaggtcccctaagaggaggcaggagatgggaggttggccggggtgtgctgctgggggtggggtttctttgaggtgaagccaaacctgctcacctgctgctggccccatggcctcttctcctgtgcctgcaggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaaggtgtggaacctgaaggctcccctgggtaatgccagggtgggaacagagcccccctagtcttccagcctgtgacttatca

SEQ ID NO: 305717 - DNA, 602 bp, Homo sapiens
accaagagatcatcactaagggagcagtgggactgggatccccatggggagggtgtccgtgttcatctggaactgcactagccttggtgaaatctaggggtccctaggaggaacctcagtgccccttcttcttcccatagatgctctcccctcctcggaggatgatgatgatgatgatgactcctcttcagaggagaaagaaacagataacaccaaaccaaaccgtatgcgtgagacactgtttcctatcttactgccctttgggtctgggcattgggtttaagaggggaggggaaggctgaaaggggaggaagaggagggcacatggggtcacggtgcctgttctgctaagtgccaggcactgctcacaggtgttgggcagatgggcaagacacctccaggtcctggcctgggccctgctcctgagcctgaccagctgctcctctccaccctgcctgtctctcttggctttccccgggcagccgtagctccatattggacatccccagaaaagatggaaaagaaattgcatgcagtgccggctgccaagacagtgaagttcaaatgcccttccagtgggaccccaaaccccacactgcgct

SEQ ID NO: 305718 - DNA, 562 bp, Homo sapiens
ccagccagtccacaagacaggcagaaaaaagttaaattaactggggcaaatagaactcatataacatccaaaacatgcaagattctgcagcaaactaggagtacttcagggttggtttgctatcttctttagaactaattttatcctaacagtttaagaaggtggacatttcaacaccatcttttaggtgacatgtttcttttgtgttaatttgactcccctgaatgacctagttagtaaactagtcactagtaattcagtcaccaggcaaatcaagcctgcaagaaagaaggccagtattcacaatgccgtgttatcagctgaacccactcaaatagtttattttaatcattaatatgtagcttcaataatgagatgtggacgcggtggctcatgcctgtaatcccagcactttgggaggccgaggtgggtggatcacttgaggttaggagtacaagaccaacctggctaatatggtgaaaccccgtctctactaaaaaaaaaatacaaaaattagctgggcgtggtggcgatcacctgtaatcctagctactcaggaggc

SEQ ID NO: 305719 - DNA, 1040 bp, Homo sapiens
tgagacggaggttcactctttttatccaggctggagtgcaatggcatgatctcggctcactgcaacccctgcctccccagcaggaacaatagtcataaatgcacttttcacactaaaggtttctttattagttctccagttaaacctagatccctccctggtagattgcgaactcaaagttttgtgatcccaaagccattccactgcaaatgcccagcagtgaagatggcctcaaattgggttcttgcctgcagtgtgtgtggcagcagcccatgtgcctttacctgttgtcaaacttgcaagcatttatttgtctttatgactgtcatggggactgaggttcttcagagaaagagtgtgagctgatgacacagtggttttacacccaccccctgggcagggagtttgcacgtagttgtgagctgtgagtggttagtgcattgctggtattgctgaaggcagggttgatccctcacttgactgatacttggattcaagagaatctagattgtgttgggggagggactgactgtactcatggctaacttaaagtattaaaataaggctgtcccctacaaccttcttagtcacacaggatccctgtagccaaaacagtatatgatccagctgcagagagcagactgctctcagcttgcacagcaccttaggcgagggaagaatatacggatagggaatggggtggagaaaggatgggaatgttgtcatccaggtggctttagggtcctaaggagtggagaaggatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgta

SEQ ID NO: 305720 - DNA, 556 bp, Homo sapiens
ttggctgtgtgtgacctcaggcaagctagtgaaccctgatgtggctccgttcacagatttctatgatggggataatatgttcccatctaggcaatatcatgaggatgtacgcactgatatatttaagggctcagaagagtacctgacacacagtgagcactatgaaatgcccccctgcatgacccgcagcatgcctggggcggaaggaggagaggtgttgcggtttgccctgctgcctccccagcaggaacaatagtcataaatgcacttttcacactaaaggtttctttattagttctccagttaaacctagatccctcccagtatgacaccccgaatgcccccccgaatgcatgcttcggggggaaaaaacaagatctgtcatttgtcatcagatggacgaagacagctacttgactcaaagagaacctgccgcgagtcttagtctttggaaggtcagacagctgcagtgttcggtcacatggagatggtgtcttcatgtctcagagaccgcacttctgtaggccagacgtgtgctcacctaacctacacacgc

SEQ ID NO: 305721 - DNA, 5370 bp, Homo sapiens
aggcaggatctgttgttcattaccccatggcatcctttcaggacaaccccagagggtgttgtgatggggagcagcaggcctggggcaaggaaggaagggggtgcacacaggagaagaaacattccaaaatcagggcctccctgttctttcctccccatccctagctcctgcaagagaaagtccaggctttgggagcagatggcagagggagggagtaaagaaagagccaaaaatgatgatccacagcttatagtagcagttaaactgtcagaagttttttttcttttttgtggtagaagggcaggaggccccaaggttggaaataagagggttcccacccagaacccttcttgtgagagatgcgcactttaaagggtgattttgttccagatgtctatggctgggtgtgtgggggaggagcactctcatctgcaggactctgcttgatcctctgcttcatagcccttccccatctctcctcaccattctgcctacaaggcttctagcagcacgggggcccggagggagagccccttcagggttcagagtgaagtactaccttgccagggactcagtcaggggactttgggagaaagacttgatagccaggctgactgggttctaggcaggccctctggaaagggtagctcacctaacaaagctcctccaactcagcatgccagacccactttgaaatctcacagaatcttgctggtaatggtgactttagaactagtagaccctttttcctaggcactgaccccccacctttgtctgtgttgtgcccaagtgcctgcgccacccccaccctcctgctgcgctgaccgctgcatggtgtcgtgacctgggcctcatttgtagctgcactgcctttccttgtctgcaaagttggttttgtccactctgaccaagacctctagtttttggtgggtagggggtctctctggtttccccttcagctataatctctatttttaaaatctcaaaatcatgtcccctccacttccactgccaaacagcttggtgaagaaacaagaagggaactatgccctgggccagggcgaatgcgtggctgggcagtgcccatcatggcattttcacatgtcccatatgcccctcctgtcttattccactgcttctcccagcattctggtgcctccaagccatcccctcccaccaccagctctaagattctaggatagtcttgataacatttcagtacctgaatagatgtcattttgtgttggtatattcctctgcaaaaagtattttcaatcttggttgcattggcaccccccctaccccccaccaatgtcttaatcccacattttcttcacaacttttagcatcagctcagaccgtggggttccactgggtattgggaattaggctcccccactagctttcaggtgggtaagtttttttgtttgtttttgggggtctttagactcttgaaggcaactcagggtattgtccacgcagctctctggttagacttctcccaggctatgatcctggcatgtcctttataaggtatacttggattggccgagacctggcctggcatcaggagtccaaacctctgaggtctgatctctgctctgtcaaggactttcggcaagtctcgtgacctctggctctttcacttcctccccacctgccaaatggggataaataatcttacctacctcctggggggaggggaagttctgagaatggagtcattcttagtgttcaggtgctaaaggttgttctcctgggggaacagagtgactgaaactggcttgtttgctacaagccctaccctccactctttcattccttgaaagcagtttgcctggtcagtcagcttttgggggtccatcaaaggaggttgctgacctgaccgtgagtgcttcagtatctggtttgtgtcagaaccagacgccaactttgtactgcatttgggatcatatctttccccttctctgtcccccattctctgaatgctgctttctctggcttgtttcctacagtgggggcctgtggggttgagtcttgaggaatcccctcaaatgagaaggccttgggagaaggcctcatctctggctgtttcatgagcaactcattcctagagttcattgtttgcatgggtttctcacaagcgtccttcctcataggaaggctcatcaactgaatttagtgacatgtacacagtagatgctcaagcagtgtctgcaaggacacaagctgagctttctccttatggggcaaacctatgtctaaccagatacagaccaattagtttagatcaaatcaccttccacttgggctacttgtgactttccaacctggtaacttccactgaattctggaaagagaaattcttgaggaccctggcaagttgggccctgacctttctgttgctgtctcttgctggtgaagcaataccagcagttcctgtaataccacaatatcgttccatgcatatataacatattaatacttgattttgctgagctgcaaaggtatctgtcataaaatatggtccccaggaaaagaatctctgtgctctaaatctcggtcagagctgtggcctcccccttgcctttaacctctagtttagtcttttcctccaggcatgaaaaatatgactaacctgtggtgtgtccattcttccttataggaatttcctgagtttgcaggagacatgagagcagtttttagcgagtattttagtgggaagttgccaactttttaagaatgagcagttgacaagggccagagcctgtcccttgtcagcagtaggacatttccagctcttaggaatagaaaggaggactgctgactgtctggcgctgtataaaaatgtgtataccaatttgggaataggggaacccagtcatggatggataataagccaagtcttgaatcattcctatcaagattagtatacatgaggaagaggtggcatggggggaaggggctctgggagttcagagctgagtacttgtacctgagggagggcccccagccaatctgggctggtccttctatattcttggtcccagttggtcataacaccaagggctttgccctgcgctgctttgccactgctgctgtccgctcactgtcctgcctgctgtcctctacagctccctatccttccatgtctttggccatgtagattaagtgtaggcgtccggttcattcttacctgtgttaggccatgttattttatagcgaagtcatgttcgatagggatggtatgaaatgctgctggtgggctggtaaatccaaagggataaggcttcagtgctgttgggagccctttggctccaaatgtctgactatcttgagggagaaacaagcaggtttctactagtggtgtcttctgttgtattaacttctttcctttgtggtatcttgtatcctgttttaaaaactaaatgaagggaaccacattagggcccatgccagcatcccagtgaagttcgtccagctccagttaggtggattctggagttcggagagggtttaaagtttggctgaaatagcacctcaagtggggtttagttttatttttacctgcgggcatcatgggcgatttagggggaagcacaggatggtggtgtggtttaaacctgcagcaagcaggcatgttgaagagttgagtgatcacgctggagatgaagggttggacatggattgactgggaaaaggcctgggtccattggagtaaagataacctagtcgattgaattggccatgggaagttaggtcacagtcttataaacaaagtaaataggacagagactaagttttagggagacatcttggcctcctaggctaagtttactaaaccacactgaagctatagtaccttccagatgggcaaaagtgtacactacagttgaggagctgaaccttattaggttggatgtcgatcaggaacctgtttgccctttgctgggaagccttcactctccagctttcctggggtagggaaggtctcccacattatgcaataataaaataagcatctgggtctttgcagctgtcagttgctctttcaactctaggatccatctttggaccagaagcctggtctgtgcctaggatgacactggccccagagatgctagagtcgactgcactctctccttagctgcagaccatgcacagtgcctggggcggaaggaggagaggtgttgcggtttgccctgctgcctccccagcaggaacaatagtcataaatgcacttttcacactaaaggtttctttattagttctccagttaaacctagatccctccctggtagattgcgaactcaaagttttgtgatcccaaagccattccactgcaaatgcccagcagtgaagatggcctcaaattgggttcttgcctgcagtgtgtgtggcagcagcccatgtgcctttacctgttgtcaaacttgcaagcatttatttgtctttatgactgtcatggggactgaggttcttcagagaaagagtgtgagctgatgacacagtggttttacacccaccccctgggcagggagtttgcacgtagttgtgagctgtgagtggttagtgcattgctggtattgctgaaggcagggttgatccctcacttgactgatacttggattcaagagaatctagattgtgttgggggagggactgactgtactcatggctaacttaaagtattaaaataaggctgtcccctacaaccttcttagtcacacaggatccctgtagccaaaacagtatatgatccagctgcagagagcagactgctctcagcttgcacagcaccttaggcgagggaagaatatacggatagggaatggggtggagaaaggatgggaatgttgtcatccaggtggctttagggtcctaaggagtggagaaggatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgtatatttgtacttttgtgagatcctttttgctgttttaccattttaagtctctgtacttggctacacacagattgtatttttattgttaatgctcttcttatggatacctgcatttaacttgtggactatgtaaacacaatatctatcaatatctatatatctatatatctatctatataaactactagcttttc

SEQ ID NO: 305722 - DNA, 5177 bp, Homo sapiens
aggcaggatctgttgttcattaccccatggcatcctttcaggacaaccccagagggtgttgtgatggggagcagcaggcctggggcaaggaaggaagggggtgcacacaggagaagaaacattccaaaatcagggcctccctgttctttcctccccatccctagctcctgcaagagaaagtccaggctttgggagcagatggcagagggagggagtaaagaaagagccaaaaatgatgatccacagcttatagtagcagttaaactgtcagaagttttttttcttttttgtggtagaagggcaggaggccccaaggttggaaataagagggttcccacccagaacccttcttgtgagagatgcgcactttaaagggtgattttgttccagatgtctatggctgggtgtgtgggggaggagcactctcatctgcaggactctgcttgatcctctgcttcatagcccttccccatctctcctcaccattctgcctacaaggcttctagcagcacgggggcccggagggagagccccttcagggttcagagtgaagtactaccttgccagggactcagtcaggggactttgggagaaagacttgatagccaggctgactgggttctaggcaggccctctggaaagggtagctcacctaacaaagctcctccaactcagcatgccagacccactttgaaatctcacagaatcttgctggtaatggtgactttagaactagtagaccctttttcctaggcactgaccccccacctttgtctgtgttgtgcccaagtgcctgcgccacccccaccctcctgctgcgctgaccgctgcatggtgtcgtgacctgggcctcatttgtagctgcactgcctttccttgtctgcaaagttggttttgtccactctgaccaagacctctagtttttggtgggtagggggtctctctggtttccccttcagctataatctctatttttaaaatctcaaaatcatgtcccctccacttccactgccaaacagcttggtgaagaaacaagaagggaactatgccctgggccagggcgaatgcgtggctgggcagtgcccatcatggcattttcacatgtcccatatgcccctcctgtcttattccactgcttctcccagcattctggtgcctccaagccatcccctcccaccaccagctctaagattctaggatagtcttgataacatttcagtacctgaatagatgtcattttgtgttggtatattcctctgcaaaaagtattttcaatcttggttgcattggcaccccccctaccccccaccaatgtcttaatcccacattttcttcacaacttttagcatcagctcagaccgtggggttccactgggtattgggaattaggctcccccactagctttcaggtgggtaagtttttttgtttgtttttgggggtctttagactcttgaaggcaactcagggtattgtccacgcagctctctggttagacttctcccaggctatgatcctggcatgtcctttataaggtatacttggattggccgagacctggcctggcatcaggagtccaaacctctgaggtctgatctctgctctgtcaaggactttcggcaagtctcgtgacctctggctctttcacttcctccccacctgccaaatggggataaataatcttacctacctcctggggggaggggaagttctgagaatggagtcattcttagtgttcaggtgctaaaggttgttctcctgggggaacagagtgactgaaactggcttgtttgctacaagccctaccctccactctttcattccttgaaagcagtttgcctggtcagtcagcttttgggggtccatcaaaggaggttgctgacctgaccgtgagtgcttcagtatctggtttgtgtcagaaccagacgccaactttgtactgcatttgggatcatatctttccccttctctgtcccccattctctgaatgctgctttctctggcttgtttcctacagtgggggcctgtggggttgagtcttgaggaatcccctcaaatgagaaggccttgggagaaggcctcatctctggctgtttcatgagcaactcattcctagagttcattgtttgcatgggtttctcacaagcgtccttcctcataggaaggctcatcaactgaatttagtgacatgtacacagtagatgctcaagcagtgtctgcaaggacacaagctgagctttctccttatggggcaaacctatgtctaaccagatacagaccaattagtttagatcaaatcaccttccacttgggctacttgtgactttccaacctggtaacttccactgaattctggaaagagaaattcttgaggaccctggcaagttgggccctgacctttctgttgctgtctcttgctggtgaagcaataccagcagttcctgtaataccacaatatcgttccatgcatatataacatattaatacttgattttgctgagctgcaaaggtatctgtcataaaatatggtccccaggaaaagaatctctgtgctctaaatctcggtcagagctgtggcctcccccttgcctttaacctctagtttagtcttttcctccaggcatgaaaaatatgactaacctgtggtgtgtccattcttccttataggaatttcctgagtttgcaggagacatgagagcagtttttagcgagtattttagtgggaagttgccaactttttaagaatgagcagttgacaagggccagagcctgtcccttgtcagcagtaggacatttccagctcttaggaatagaaaggaggactgctgactgtctggcgctgtataaaaatgtgtataccaatttgggaataggggaacccagtcatggatggataataagccaagtcttgaatcattcctatcaagattagtatacatgaggaagaggtggcatggggggaaggggctctgggagttcagagctgagtacttgtacctgagggagggcccccagccaatctgggctggtccttctatattcttggtcccagttggtcataacaccaagggctttgccctgcgctgctttgccactgctgctgtccgctcactgtcctgcctgctgtcctctacagctccctatccttccatgtctttggccatgtagattaagtgtaggcgtccggttcattcttacctgtgttaggccatgttattttatagcgaagtcatgttcgatagggatggtatgaaatgctgctggtgggctggtaaatccaaagggataaggcttcagtgctgttgggagccctttggctccaaatgtctgactatcttgagggagaaacaagcaggtttctactagtggtgtcttctgttgtattaacttctttcctttgtggtatcttgtatcctgttttaaaaactaaatgaagggaaccacattagggcccatgccagcatcccagtgaagttcgtccagctccagttaggtggattctggagttcggagagggtttaaagtttggctgaaatagcacctcaagtggggtttagttttatttttacctgcgggcatcatgggcgatttagggggaagcacaggatggtggtgtggtttaaacctgcagcaagcaggcatgttgaagagttgagtgatcacgctggagatgaagggttggacatggattgactgggaaaaggcctgggtccattggagtaaagataacctagtcgattgaattggccatgggaagttaggtcacagtcttataaacaaagtaaataggacagagactaagttttagggagacatcttggcctcctaggctaagtttactaaaccacactgaagctatagtaccttccagatgggcaaaagtgtacactacagttgaggagctgaaccttattaggttggatgtcgatcaggaacctgtttgccctttgctgggaagccttcactctccagctttcctggggtagggaaggtctcccacattatgcaataataaaataagcatctgggtctttgcagctgtcagttgctctttcaactctaggatccatctttggaccagaagcctggtctgtgcctaggatgacactggccccagagatgctagagtcgactgcactctctccttagctgcagaccatgcacagtgcctggggcggaaggaggagaggtgttgcggtttgccctgctgcctccccagcaggaacaatagtcataaatgcacttttcacactaaaggtttctttattagttctccagttaaacctagatccctccctggtagattgcgaactcaaagttttgtgatcccaaagccattccactgcaaatgcccagcagtgaagatggcctcaaattgggttcttgcctgcagtgtgtgtggcagcagcccatgtgcctttacctgttgtcaaacttgcaagcatttatttgtctttatgactgtcatggggactgaggttcttcagagaaagagtgtgagctgatgacacagtggttttacacccaccccctgggcagggagtttgcacgtagttgtgagctgtgagtggttagtgcattgctggtattgctgaaggcagggttgatccctcacttgactgatacttggattcaagagaatctagattgtgttgggggagggactgactgtactcatggctaacttaaagtattaaaataaggctgtcccctacaaccttcttagtcacacaggatccctgtagccaaaacagtatatgatccagctgcagagagcagactgctctcagcttgcacagcaccttaggcgagggaagaatatacggatagggaatggggtggagaaaggatgggaatgttgtcatccaggtggctttagggtcctaaggagtggagaaggatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgta

SEQ ID NO: 305723 - DNA, 4054 bp, Homo sapiens
cctcactcccactccacaccaccactaggcagagagctggtttaaataggagaggctgggtattgggaattaggctcccccactagctttcaggtgggtaagtttttttgtttgtttttgggggtctttagactcttgaaggcaactcagggtattgtccacgcagctctctggttagacttctcccaggctatgatcctggcatgtcctttataaggtatacttggattggccgagacctggcctggcatcaggagtccaaacctctgaggtctgatctctgctctgtcaaggactttcggcaagtctcgtgacctctggctctttcacttcctccccacctgccaaatggggataaataatcttacctacctcctggggggaggggaagttctgagaatggagtcattcttagtgttcaggtgctaaaggttgttctcctgggggaacagagtgactgaaactggcttgtttgctacaagccctaccctccactctttcattccttgaaagcagtttgcctggtcagtcagcttttgggggtccatcaaaggaggttgctgacctgaccgtgagtgcttcagtatctggtttgtgtcagaaccagacgccaactttgtactgcatttgggatcatatctttccccttctctgtcccccattctctgaatgctgctttctctggcttgtttcctacagtgggggcctgtggggttgagtcttgaggaatcccctcaaatgagaaggccttgggagaaggcctcatctctggctgtttcatgagcaactcattcctagagttcattgtttgcatgggtttctcacaagcgtccttcctcataggaaggctcatcaactgaatttagtgacatgtacacagtagatgctcaagcagtgtctgcaaggacacaagctgagctttctccttatggggcaaacctatgtctaaccagatacagaccaattagtttagatcaaatcaccttccacttgggctacttgtgactttccaacctggtaacttccactgaattctggaaagagaaattcttgaggaccctggcaagttgggccctgacctttctgttgctgtctcttgctggtgaagcaataccagcagttcctgtaataccacaatatcgttccatgcatatataacatattaatacttgattttgctgagctgcaaaggtatctgtcataaaatatggtccccaggaaaagaatctctgtgctctaaatctcggtcagagctgtggcctcccccttgcctttaacctctagtttagtcttttcctccaggcatgaaaaatatgactaacctgtggtgtgtccattcttccttataggaatttcctgagtttgcaggagacatgagagcagtttttagcgagtattttagtgggaagttgccaactttttaagaatgagcagttgacaagggccagagcctgtcccttgtcagcagtaggacatttccagctcttaggaatagaaaggaggactgctgactgtctggcgctgtataaaaatgtgtataccaatttgggaataggggaacccagtcatggatggataataagccaagtcttgaatcattcctatcaagattagtatacatgaggaagaggtggcatggggggaaggggctctgggagttcagagctgagtacttgtacctgagggagggcccccagccaatctgggctggtccttctatattcttggtcccagttggtcataacaccaagggctttgccctgcgctgctttgccactgctgctgtccgctcactgtcctgcctgctgtcctctacagctccctatccttccatgtctttggccatgtagattaagtgtaggcgtccggttcattcttacctgtgttaggccatgttattttatagcgaagtcatgttcgatagggatggtatgaaatgctgctggtgggctggtaaatccaaagggataaggcttcagtgctgttgggagccctttggctccaaatgtctgactatcttgagggagaaacaagcaggtttctactagtggtgtcttctgttgtattaacttctttcctttgtggtatcttgtatcctgttttaaaaactaaatgaagggaaccacattagggcccatgccagcatcccagtgaagttcgtccagctccagttaggtggattctggagttcggagagggtttaaagtttggctgaaatagcacctcaagtggggtttagttttatttttacctgcgggcatcatgggcgatttagggggaagcacaggatggtggtgtggtttaaacctgcagcaagcaggcatgttgaagagttgagtgatcacgctggagatgaagggttggacatggattgactgggaaaaggcctgggtccattggagtaaagataacctagtcgattgaattggccatgggaagttaggtcacagtcttataaacaaagtaaataggacagagactaagttttagggagacatcttggcctcctaggctaagtttactaaaccacactgaagctatagtaccttccagatgggcaaaagtgtacactacagttgaggagctgaaccttattaggttggatgtcgatcaggaacctgtttgccctttgctgggaagccttcactctccagctttcctggggtagggaaggtctcccacattatgcaataataaaataagcatctgggtctttgcagctgtcagttgctctttcaactctaggatccatctttggaccagaagcctggtctgtgcctaggatgacactggccccagagatgctagagtcgactgcactctctccttagctgcagaccatgcacagtgcctggggcggaaggaggagaggtgttgcggtttgccctgctgcctccccagcaggaacaatagtcataaatgcacttttcacactaaaggtttctttattagttctccagttaaacctagatccctccctggtagattgcgaactcaaagttttgtgatcccaaagccattccactgcaaatgcccagcagtgaagatggcctcaaattgggttcttgcctgcagtgtgtgtggcagcagcccatgtgcctttacctgttgtcaaacttgcaagcatttatttgtctttatgactgtcatggggactgaggttcttcagagaaagagtgtgagctgatgacacagtggttttacacccaccccctgggcagggagtttgcacgtagttgtgagctgtgagtggttagtgcattgctggtattgctgaaggcagggttgatccctcacttgactgatacttggattcaagagaatctagattgtgttgggggagggactgactgtactcatggctaacttaaagtattaaaataaggctgtcccctacaaccttcttagtcacacaggatccctgtagccaaaacagtatatgatccagctgcagagagcagactgctctcagcttgcacagcaccttaggcgagggaagaatatacggatagggaatggggtggagaaaggatgggaatgttgtcatccaggtggctttagggtcctaaggagtggagaaggatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgtatatttgtacttttgtgagatcctttttgctgttttaccattttaagtctctgtacttggctacacacagattgtatttttattgttaatgctcttcttatggatacctgcatttaacttgtggactatgtaaacacaatatctatcaatatctatatatctatatatctatctatataaactactagcttttc

SEQ ID NO: 305724 - DNA, 1233 bp, Homo sapiens
tgagacggaggttcactctttttatccaggctggagtgcaatggcatgatctcggctcactgcaacccctgcctccccagcaggaacaatagtcataaatgcacttttcacactaaaggtttctttattagttctccagttaaacctagatccctccctggtagattgcgaactcaaagttttgtgatcccaaagccattccactgcaaatgcccagcagtgaagatggcctcaaattgggttcttgcctgcagtgtgtgtggcagcagcccatgtgcctttacctgttgtcaaacttgcaagcatttatttgtctttatgactgtcatggggactgaggttcttcagagaaagagtgtgagctgatgacacagtggttttacacccaccccctgggcagggagtttgcacgtagttgtgagctgtgagtggttagtgcattgctggtattgctgaaggcagggttgatccctcacttgactgatacttggattcaagagaatctagattgtgttgggggagggactgactgtactcatggctaacttaaagtattaaaataaggctgtcccctacaaccttcttagtcacacaggatccctgtagccaaaacagtatatgatccagctgcagagagcagactgctctcagcttgcacagcaccttaggcgagggaagaatatacggatagggaatggggtggagaaaggatgggaatgttgtcatccaggtggctttagggtcctaaggagtggagaaggatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgtatatttgtacttttgtgagatcctttttgctgttttaccattttaagtctctgtacttggctacacacagattgtatttttattgttaatgctcttcttatggatacctgcatttaacttgtggactatgtaaacacaatatctatcaatatctatatatctatatatctatctatataaactactagcttttc

SEQ ID NO: 305725 - DNA, 498 bp, Homo sapiens
ttaattcgcggccttgtcgactaatgatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgtatatttgtacttttgtgagatcctttttgctgttttaccattttaagtctctgtacttggctacacacagattgtatttttattgttaatgctcttcttatggatacctgcatttaacttgtggactatgtaaacacaatatctatcaatatctatatatctatatatctatctatataaactactagcttttc

SEQ ID NO: 305726 - DNA, 3875 bp, Homo sapiens
cagtttgcaaaagccagaggtgcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaaggggggcaggaaaaaaaaaaaacccaacaacttagcggaaacttctcagagaatgctccaaaactcagcagtgcttctggtgctggtgatcagtgcttctgcaacccatgaggcggagcagaatgactctgtgagccccaggaaatcccgagtggcggctcaaaactcagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccaattttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgatcattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttatctgaaggaccccaggtaagatgttaatctcccagcccacctcaacccagaggctactcttgacttagacctatactgaaagatctctgtcacatccaactggaaattccaggaaccaaaaagagcatccctatgggcttggaccacttacagtgtgataaggcctactatacattaggaagtggcagttctttactcgtcccctttcatcggtgcctggtactctggcaaatgatgatggggtgggagactttccattaaatcaatcaggaatgagtcaatcagcctttaggtctttagtccgggggacttggggctgagagagtataaataaccctgggctgtccagccttaatagacttctcttacattttcgtcctgtagcacgctgcctgccaaagtagtcctggcagctggaccatctctgtaggatcgtaaaaaaatagaaaaaaagaaaaaaaaaagaaagaaagagggaaaaagagctggtggtttgatcatttctgccatgatgtttacaagatggcgaccaccaaagtcaaacgactaacctatctatgaacaacagtagtttctcagggtcactgtccttgaacccaacagtcccttatgagcgtcactgcccaccaaaggtcaatgtcaagagaggaagagagggaggaggggtaggactgcaggggccactccaaactcgcttaggtagaaactattggtgcttgactctcactaggctaaactcaagatttgaccaaatcgagtgatagggatcctggtgggaggagagagggcacatctccagaaaaatgaaaagcaatacaactttaccataaagcctttaaaaccagtaacgtgctgctcaaggaccaagagcaattgcagcagacccagcagcagcagcagcagcacaaacattgctgcctttgtccccacacagcctctaagcgtgctgacatcagattgttaagggcatttttatactcagaactgtcccatccccaggtccccaaacttatggacactgccttagcctcttggaaatcaggtagaccatattctaagttagactcttcccctccctcccacacttcccacccccaggcaaggctgacttctctgaatcagaaaagctattaaagtttgtgtgttgtgtccattttgcaaacccaactaagccaggaccccaatgcgacaagtagttcatgagtattcctagcaaatttctctctttcttcagttcagtagatttccttttttcttttcttttttttttttttttttttttggctgtgacctcttcaaaccgtggtacccccccttttctccccacgatgatatctatatatgtatctacaatacatatatctacacatacagaaagaagcagttctcacaatgttgctagttttttgcttctctttcccccaccctactccctccaattcccccttaaacttccaaagcttcgtcttgtgtttgctgcagagtgattcgggggctgacctagaccagtttgcatgattcttctcttgtgatttggttgcactttagacatttttgtgccattatatttgcattatgtatttataatttaaatgatatttaggtttttggctgagtactggaataaacagtgagcatatctggtatatgtcattatttattgttaaattacatttttaagctccatgtgcatataaaggttatgaaacatatcatggtaatgacagatgcaagttattttatttgcttatttttataattaaagatgccatagcataatatgaagcctttggtgaattccttctaagataaaaataataataaagtgttacgttttattggt

SEQ ID NO: 305727 - DNA, 4363 bp, Homo sapiens
acccctgtcctgcatactttctttgctgaggttgggccatacctctccctggttatgcactctcatgtgattctgccttccgatgtcggtacgtgagagtcctcctcaccttcggaggttcctgaggaggacttctcagctttctgcggctccttgctgcgttctcctgctgaacgttcagcttcgtggttgtcatttggacacactggtctgtccgcaggatgttggaagaggactgcccatgttaggcccaattttctcccattcacggctgtctctgaattgtgctgaccgtgtcttcatcacagttccagcagcgcttcggacaagtcctgttatagtatctgttcggagaagtgatctgggcagcttggcacgacctcagtgactggcttcacgggcttccgcttgcacgatgctgcacacaattcagcattgctgtagcactcttcctgcacctcagcaatcatcctttggcaaagtggagcacctccgaatggacgaggaagaccttggaggtgaccccgttggcgatgcattttaagctctctttgacgtaatgcttttccctgagtgtcacatttagcagcgctgtaccacgaaggatttacagatgtcatacatcccatctgtgtcacatgctggagttttccaggcatgcaaaagccccgcagcctgacctgtagagcactagtttgacggcaacgtaaccactctcatgctcgaagttcttgatgccgccatctcgggatcttcctggggttctcagagaatgctccaaaactcagcagtgcttctggtgctggtgatcagtgcttctgcaacccatgaggcggagcagaatgactctgtgagccccaggaaatcccgagtggcggctcaaaactcagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccaattttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgatcattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttatctgaaggaccccaggtaagatgttaatctcccagcccacctcaacccagaggctactcttgacttagacctatactgaaagatctctgtcacatccaactggaaattccaggaaccaaaaagagcatccctatgggcttggaccacttacagtgtgataaggcctactatacattaggaagtggcagttctttactcgtcccctttcatcggtgcctggtactctggcaaatgatgatggggtgggagactttccattaaatcaatcaggaatgagtcaatcagcctttaggtctttagtccgggggacttggggctgagagagtataaataaccctgggctgtccagccttaatagacttctcttacattttcgtcctgtagcacgctgcctgccaaagtagtcctggcagctggaccatctctgtaggatcgtaaaaaaatagaaaaaaagaaaaaaaaaagaaagaaagagggaaaaagagctggtggtttgatcatttctgccatgatgtttacaagatggcgaccaccaaagtcaaacgactaacctatctatgaacaacagtagtttctcagggtcactgtccttgaacccaacagtcccttatgagcgtcactgcccaccaaaggtcaatgtcaagagaggaagagagggaggaggggtaggactgcaggggccactccaaactcgcttaggtagaaactattggtgcttgactctcactaggctaaactcaagatttgaccaaatcgagtgatagggatcctggtgggaggagagagggcacatctccagaaaaatgaaaagcaatacaactttaccataaagcctttaaaaccagtaacgtgctgctcaaggaccaagagcaattgcagcagacccagcagcagcagcagcagcacaaacattgctgcctttgtccccacacagcctctaagcgtgctgacatcagattgttaagggcatttttatactcagaactgtcccatccccaggtccccaaacttatggacactgccttagcctcttggaaatcaggtagaccatattctaagttagactcttcccctccctcccacacttcccacccccaggcaaggctgacttctctgaatcagaaaagctattaaagtttgtgtgttgtgtccattttgcaaacccaactaagccaggaccccaatgcgacaagtagttcatgagtattcctagcaaatttctctctttcttcagttcagtagatttccttttttcttttcttttttttttttttttttttttggctgtgacctcttcaaaccgtggtacccccccttttctccccacgatgatatctatatatgtatctacaatacatatatctacacatacagaaagaagcagttctcacaatgttgctagttttttgcttctctttcccccaccctactccctccaattcccccttaaacttccaaagcttcgtcttgtgtttgctgcagagtgattcgggggctgacctagaccagtttgcatgattcttctcttgtgatttggttgcactttagacatttttgtgccattatatttgcattatgtatttataatttaaatgatatttaggtttttggctgagtactggaataaacagtgagcatatctggtatatgtcattatttattgttaaattacatttttaagctccatgtgcatataaaggttatgaaacatatcatggtaatgacagatgcaagttattttatttgcttatttttataattaaagatgccatagcataatatgaagcctttggtgaattccttctaagataaaaataataataaagtgttacgttttattggt

SEQ ID NO: 305728 - DNA, 3857 bp, Homo sapiens
cagtttgcaaaagccagaggtgcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaaggggggcaggaaaaaaaaaaaacccaacaacttagcggaaacttctcagagaatgctccaaaactcagcagtgcttctggtgctggtgatcagtgcttctgcaacccatgaggcggagcagaatgactctgtgagccccaggaaatcccgagtggcggctcaaaactcagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccaattttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgatcattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttatctgaaggaccccaggtaagatgttaatctcccagcccacctcaacccagaggctacttgaaagatctctgtcacatccaactggaaattccaggaaccaaaaagagcatccctatgggcttggaccacttacagtgtgataaggcctactatacattaggaagtggcagttctttactcgtcccctttcatcggtgcctggtactctggcaaatgatgatggggtgggagactttccattaaatcaatcaggaatgagtcaatcagcctttaggtctttagtccgggggacttggggctgagagagtataaataaccctgggctgtccagccttaatagacttctcttacattttcgtcctgtagcacgctgcctgccaaagtagtcctggcagctggaccatctctgtaggatcgtaaaaaaatagaaaaaaagaaaaaaaaaagaaagaaagagggaaaaagagctggtggtttgatcatttctgccatgatgtttacaagatggcgaccaccaaagtcaaacgactaacctatctatgaacaacagtagtttctcagggtcactgtccttgaacccaacagtcccttatgagcgtcactgcccaccaaaggtcaatgtcaagagaggaagagagggaggaggggtaggactgcaggggccactccaaactcgcttaggtagaaactattggtgcttgactctcactaggctaaactcaagatttgaccaaatcgagtgatagggatcctggtgggaggagagagggcacatctccagaaaaatgaaaagcaatacaactttaccataaagcctttaaaaccagtaacgtgctgctcaaggaccaagagcaattgcagcagacccagcagcagcagcagcagcacaaacattgctgcctttgtccccacacagcctctaagcgtgctgacatcagattgttaagggcatttttatactcagaactgtcccatccccaggtccccaaacttatggacactgccttagcctcttggaaatcaggtagaccatattctaagttagactcttcccctccctcccacacttcccacccccaggcaaggctgacttctctgaatcagaaaagctattaaagtttgtgtgttgtgtccattttgcaaacccaactaagccaggaccccaatgcgacaagtagttcatgagtattcctagcaaatttctctctttcttcagttcagtagatttccttttttcttttcttttttttttttttttttttttggctgtgacctcttcaaaccgtggtacccccccttttctccccacgatgatatctatatatgtatctacaatacatatatctacacatacagaaagaagcagttctcacaatgttgctagttttttgcttctctttcccccaccctactccctccaattcccccttaaacttccaaagcttcgtcttgtgtttgctgcagagtgattcgggggctgacctagaccagtttgcatgattcttctcttgtgatttggttgcactttagacatttttgtgccattatatttgcattatgtatttataatttaaatgatatttaggtttttggctgagtactggaataaacagtgagcatatctggtatatgtcattatttattgttaaattacatttttaagctccatgtgcatataaaggttatgaaacatatcatggtaatgacagatgcaagttattttatttgcttatttttataattaaagatgccatagcataatatgaagcctttggtgaattccttctaagataaaaataataataaagtgttacgttttattggt

SEQ ID NO: 305729 - DNA, 413 bp, Homo sapiens
gcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaaggggggcaggaaaaaaaaaaaacccaacaacttagcggaaacttctcagagaatgctccaaaactcagcagtgcttctggtgctggtgatcagtgcttctgcaacccatgaggcggagcagaatgactctgtgagccccaggaaatcccgagtggcggctcaaaactcaggtaagcagcaaacccaagagcggtttctcccc

SEQ ID NO: 305730 - DNA, 1395 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctata

SEQ ID NO: 305731 - DNA, 1358 bp, Homo sapiens
ggtcgtagctcatgccggcgggcggcggccgggcctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctata

SEQ ID NO: 305732 - DNA, 1545 bp, Homo sapiens
cacaagaaataaagaccatagttggaggttaatggacagccagaactttagatcttgtggtaggtttcccagctctggagggtcattatggtgaaacgttctttatagtactgggctggaataaataaatagcagttgaggaattttaccttgtaactgtaatataatgtaaaaagaaagcacacttttaataaccctggtatgtgaagaggaaagaaaaaaaatccaaaacaatttggtggtactgaaaatcttacggagagttaaaaataatactaatcctcgcccggctgaactggaattcttgcagttacaaagttaaaatttcaagtaaacactgtatttttcactttttgtagacagacacagtgcagatacaaacagctgccatatctcacctcagatgaagctatgtgtcaatgcttagggaaaatgatcttagataatttcccaattttatagagcttaaatctttgaaaacagcactaatactgctggttgactggctatctacaacagcaaagtgaacataaagttttgacgatgagaggtttcccaaagaaactaatatagagtttttagttgaacagatacagttactttagttttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctata

SEQ ID NO: 305733 - DNA, 1899 bp, Homo sapiens
  misc_feature (1400)..(1400): n is a, c, g, or t
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctataaaaanaacacaaacaaacacaaacaacaaaaaaaaaacaaaacaaaaaacaaaacaacaaacaacacaaaaacacaaaacaaggggggcgcccaccaaaaactaccccccgggggagacgacataagaagcacacgccaacgagcttatattatgacaaaaagagggctccacataacgagaacgaacaaataaaagccacaaccaaccaggccgagataaaaaaaacagcgtcgagcgagcaacacaccacacctatgcgtgcactatagtaagagagagaccccccacaaacgccgggcgggaggggaaaaacaaaggataaagcaaacacaaccacaccacgaacaaaaaataacaacccgacacgaagaaccaccaaaagacaacaaccaaaaaaaaaaacaaagaccgagaaaaaaccagagcacaaaaaatctgccgcgcaaacacaaacaaaccgacctctcacacgacacccacacacgccacaaactgaattccg

SEQ ID NO: 305734 - DNA, 1636 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctataaaaaaaagaacgaaattaaaataaataaaaaaaaaaaaaagaggggggggggaaaaagaattcccaggggggcgaaatttaggggcgaccggttttttttacaagggggcccctatgggggtgtttaaaaaaagcagggaaggataaaaaggaaggaaaacggggcgtgatttgtgggaggcactttgtgtgtgtgtaattggaaacaccaaattggcggaaataatgttgttgtacaggt

SEQ ID NO: 305735 - DNA, 1582 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctatattttaaaagaaaaaagagttgtaaaccaaaaaaatagcattatgtgaaaacccttcggggggggcccggtacccaaatccccttataaggggaccctgttcccccccgctcaatgggcggttgtttaaaaaacaatcttaactggggaaaaacccgggggggttacccaaaaattaattgcccttgg

SEQ ID NO: 305736 - DNA, 1520 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgttggaatagttacaataactaggttttcaaaaaaaaaaagaaaaaaaaattgggggggcacgaaagtttaacattggggggggcagtaaaaaggaaggcaagaagggggaagggggttcacaaaaacggagggggacaaggtgggttggtaagtatttgtggggg

SEQ ID NO: 305737 - DNA, 1227 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcggtgagattgcggtgtttgaggatcctctag

SEQ ID NO: 305738 - DNA, 1380 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcggtgtttgcaaacaccgcaatctcctgcttggtgttgcgcagtcgtccccatgtctgctgctgtgacctgcagctcctcgtactttgtctgtaccaggactcagcctcagcctgctcctctgagcatctcctcatattggcctgacctagcgataatgctgtgcagtccagattgcgtgttttg

SEQ ID NO: 305739 - DNA, 1293 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagtggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctata

SEQ ID NO: 305740 - DNA, 1425 bp, Homo sapiens
tagcattggtaatatcattaaggaccaaatacctattaatatcaaaggttgtgaatgtagtgagaatattgtagacactctgtcatctgggtatattttgtgagtggactctggttagttttactgattggtgctgttgacttaatctcacctgctggatggcagaggagttatggcagttttaaagtggaagatctcaggatggctggaaagagccctatcagctgagagcagtcttcacccttcaccctgatgccagcagtcttaccaggactctgacccttttttcttggaaaatcccacgagccatgaagagattgcaatgatctctcataatggacttttttttttttatgacttgtcttttgcttcaaccgctttcaagattgatcttacaatttggcagattttgtaaatactgtggcgttttgtgtacccattaaatttatttgcactgatggttacttttattacaaaaaaagattggttacagtttaatttccttgttcagtggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctata

SEQ ID NO: 305741 - DNA, 1126 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctggatattcggcgtgtgcaggggatgctctagag

SEQ ID NO: 305742 - DNA, 1574 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaaggtatacacacacccaccaaagcaagagagagattttaagaaattggcccacgtgactgaaggctggcaagtccaaaatctgcatggtaagccggcagactggagacccagagaagagtttatgttgcattctgctgcctcagaagttctgctggcagaatttcttcttgctcaggggagatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctata

SEQ ID NO: 305743 - DNA, 1221 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgatgggatggaggtggataccacaccaacagttgctggacagtttgaggatgcagatgttgatcactgaaaatgatttatgcaagtttaagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctata

SEQ ID NO: 305744 - DNA, 974 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaagattctgctcctaagtgtaggagagaacttggtgcctcttccactctggagttcagtggcgcgatctcggctcactgtaagcgccgcctcccggttcacgccgttctcctgctatgatgggt

SEQ ID NO: 305745 - DNA, 1152 bp, Homo sapiens
cacgccgcaccgccggttcaaatgattctcctgcctcatcctcccgagtagctgggattacaggcatgtgccaccacgcctggctaattttgtaattttagtagagacagtgtttctccatgtttggtaaggctggtcttgaacttctgacctcaggttatccgcctgccttggcctcccaaagtgctgggattacaggtgtgagccaccacacctggctgtgtaaatttttaatcatttaaaattgtacatgctttaaaagaatgaataaggaataaataattaagagtagtttatgcaactgttaataatttcaggataatggaactaggacttctcagtgcatgaggtggggtggagacggcacgttaatcgtggaatcacaactctgccacatacttgtgtacacctttggacaaggcatataacttatttaatcctcacttcccccatctgtaaaatggggaggataatacctaccttgcagggttgttgcagaggctaagataaaatgtacctaagtcctctggcactcgtgactaggcattcaataagtagtagctattattattatcactactgtaaacactgtaaaccttttgtttttcagattctgctcctaagtgtaggagagaacttggtgcctcttccactctggagtgaagttaatgaaagtctttttccttttccaaaacccaacctgaaccagttctttcttgagacagactatactgagacaacaagttgtcaccagcagaagatagataatatgacctttattaacttgatgaattaacttaaccaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctata

SEQ ID NO: 305746 - DNA, 975 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaagatgggatggaggtggataccacaccaacagttgctggacagtttgaggatgcagatgttgatcactgaaaatgatttatgcaagtttaaggtgagtagttcattttctcccttgtcgctgatcatgaaaatcatatgaaatgattactttctactttttaaaattctttcttgagacagggtcttactctgtcacccaggctagagtgcagt

SEQ ID NO: 305747 - DNA, 1130 bp, Homo sapiens
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggaggcaatgttcactgcaatgtgcgaatgccaggccttgcatccagatcctgaggatgaggattcagatgactacgatggagaagaatatgatgtggaagcacatgaacaaggacagggggacatccctacattttacacctatgaagaaggattatcccatctaacagcagaaggccaagccacactggagagattagaaggaatgctttctcagtctgtgagcagccagtataatatggctggggtcaggacagaagattcaataagagattatgaaggtgagtgtccttttgcagtgtgaacagtcagatgagcacttgggcaataagttatggatagtcaatagaagttcttttaataactaagagaaagaattgactctctatagtataggaagcagatacagaattacatagtataggaatgcttatgtcatttgtttttagtgattttttttcctcattaccaaaaaagtctttgttcatagtcaaaaaaatttttttaatgtgcgcaagaaagtagaagtgaaaaagaaacaagtgtaattctaactgagagatatccactattaatttactgttgcatctgtgtattagtttgctagggctattataacaaagtgtcatacaggcggtggctcaaaca

SEQ ID NO: 305748 - DNA, 447 bp, Homo sapiens
tacttgtttgcagcggtactgtttgcagcggtactggtttgcagcggttactggtttgcagcgatactggtttgcacgcggtactggttcgcagcggcaagagggtatttgtagtttactatttaccctaaaactttctgtgtctgggtaccctctgagtaggcctataattcctaccttgactgtgtgcatcatttgtaagctagcagatctatgtggtgaaaatgcacaggagcttggtagactgcgggggaaagagagagctcctttcgccatgttttaccagtctgctgttataacctcttaggttgtatcctttaatttccagccttttaggttagtttctgtaacagaacaagtgagtctgggatgaagtcctcaaagtacttcaaatggtaattgttttgtttttgtaatagcttaacaaataaacctaggttttctata

SEQ ID NO: 305749 - DNA, 534 bp, Homo sapiens
  misc_feature (500)..(500): n is a, c, g, or t
tccggggcagactaagttgttcttccggggtgactgcctcttccagggcgggcggtgtggtgcacgcattgctgtgctccaactccctcagggcctgtgttgccgcactctgctgctatgagcttcctcaaaagtttcccgccgcctgggccagcggaggggctcctgcggcagcagccagacactgaggctgtgctgaacgggaagggcctcggcactggtaccctttacatcgctgagagccgcctgtcttggttagatggctctggattaggattctcactggaataccccaccattagtttacatgcattatccagggaccgaagtgactgtctaggagagcatttgtatgttatggtgaatgccaaatttgaagaagaatcaaaagaacctgttgctgatgaagaagaggaagacagtgatgatgatgttgaacctattactgaatttagatttgtgcctagtgataaatcagcgttggagacagaactgttcanagtcccaaatccaaataaactagttttgttctta

SEQ ID NO: 305750 - DNA, 371 bp, Homo sapiens
aagagtttatgttgcattctgctgcctcagaagttctgctggcagaatttcttcttgctcaggggaggtgagtctttttcctattgaggcctccagctgattaaatgagacccaccacactatgcagggtaatctccttcacccaattttcaccagtttacaaggctaatctcatctaaaaaataacctccacagaaacatctagaataatgtttgaccaactatctggacaccattgcctagccaagttgatgcataaatttaactatcacacccttctttttttcttaagatggagtttcgctcttgttgccgaggctggagtgcaatggcacgatcttggctcactacaacctccgcctcctgggttc

SEQ ID NO: 305751 - DNA, 444 bp, Homo sapiens
atttattgctgtttttcggtgagggtttgatggcagagttcctgaatccatctttgcttttcttttacagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccaggtaggagctgatgtccagtgaccccaaattccatgagaacactttgacaggatggtgccagcacttcccatcagttggctgtgggcattttttaaaggaagcagacatatggcaaagcaatgtgttattggatttatataatggtgagaaataaaaaaaaaaaa

SEQ ID NO: 305752 - DNA, 715 bp, Homo sapiens
agatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcatcaacgagatcctcgattgaatgaaattttatttccattttatgatgccaaaagggcaatgcagatcattgagatgtatgaacctgatgaagatttgaagaaaaaaggtaataaacatgaaaaaaggacttaaaaaaaaaaacaagaaaagatgcaacttttaaagccttggtttatttaaaggtatctgtaaatgctttgcaactccctgagccatggattgatgactatttttttttcctgctcttaagttcgtataaattttacctttcatcagaattagtcaatcctgactgaagtatactgttacatttattgtattattaaatacattatagtgatgtttccccatgtactttcttgtattagattttagtattgcatattgcttgaaatattaaaacaaccaataca

SEQ ID NO: 305753 - DNA, 5118 bp, Homo sapiens
gtgtgtccctccagtgccgcttgccccttgttctcccaagcaccagggggacccctgtcttagattcaagttgcatcactagactaacagctctgggaacagaggacactgaggactagtttgggaaatgaaaaacatctgcaatgagaggtaattttattctcctcttccttttaccctagtctcactctccatagtaggacctggatctttgcatcagagaaaacataatgaacaataactggaatgtgtgtttctttcttttctgccctagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaa

SEQ ID NO: 305754 - DNA, 5555 bp, Homo sapiens
  misc_feature (5362)..(5362): n is a, c, g, or t
gtgtgtccctccagtgccgcttgccccttgttctcccaagcaccagggggacccctgtcttagattcaagttgcatcactagactaacagctctgggaacagaggacactgaggactagtttgggaaatgaaaaacatctgcaatgagaggtaattttattctcctcttccttttaccctagtctcactctccatagtaggacctggatctttgcatcagagaaaacataatgaacaataactggaatgtgtgtttctttcttttctgccctagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttcccagtgttatacatggaaccagtttgtttttcctttgatnccaggttacttttagtatttgagacatcataccattaatccattgtagtaggattaaaatgtacacacaactcaaatgtgcaacaaaagcatgtgttacctgctattgtcagttcatattgcactcaaaccttgcattatcccttattatgaagaaaaattaatagccaattaaagtaactcagtgtcttcca

SEQ ID NO: 305755 - DNA, 4997 bp, Homo sapiens
agatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaa

SEQ ID NO: 305756 - DNA, 4536 bp, Homo sapiens
ccacaatctcaagtgttgagggttgggtcagcctactcagcagacaggcttactatacagcctgacacttggggggatctggggggcctctcacttgggaaagctaattctgaacccagccatcacaattgtcccttgcactttaccagatacttaaaaggtgcaaggccctctggggagcaggaacccctccccggcacatcccaggccagacccctgctccactggggaggttggagcagctctgcacacctctggaaactatgtggatttcaagtttgcagcactagtctaaggaaaagctcaatgggtgtgctaatttgggttggggagtgaaaacagaaggctgtgccgcctgccatctagtgggtgttgggttgcatcactcccaggcctcccaggctcctcctggactgggaaggagaatggagaagcacagcccttccttaattcagctctttctgtttctctctagcttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaa

SEQ ID NO: 305757 - DNA, 4099 bp, Homo sapiens
gaactcctggcctcccaaagtgctggattaaaggcatgagccaccgttcccggccagtaatttcttgaataaagtcccttaaaaatctaaaaatgtcctacaaatgtaagataagcttaatattttatgattacctccttttgcattattcagagctacaacagacactaacttcttaaagtatcctttagcataattgaggaagaaaaagcctttacctttcaatttgtgtgtgtgcaattatctttattaaggaaatctgcagcacgtatccgtgggtcctactgaagtcatcaacttatatgttttcttccttgtgcttgtagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaa

SEQ ID NO: 305758 - DNA, 2651 bp, Homo sapiens
agatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgacacgcccgggcgtgtgatgtgactt

SEQ ID NO: 305759 - DNA, 2717 bp, Homo sapiens
  misc_feature (2380)..(2380): n is a, c, g, or t
  misc_feature (2389)..(2389): n is a, c, g, or t
  misc_feature (2391)..(2391): n is a, c, g, or t
  misc_feature (2409)..(2409): n is a, c, g, or t
  misc_feature (2671)..(2671): n is a, c, g, or t
agatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaagggcctggtcactgtagaagatgagcaggcgtggatggcntcttataantntgtaggtgctaccactantatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaatgagtcgcatttaccccaagggaggccgagtcggttccagtaattacatgcctcagattttctggacgctggctgccagatggtttnactggactatcaaaccccagtaggggctgtttccatgaccccaatt

SEQ ID NO: 305760 - DNA, 1740 bp, Homo sapiens
agatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccaggtaggagctgatgtccagtgaccccaaattccatgagaacactttgacaggatggtgccagcacttcccatcagttggctgtgggcattttttaaaggaagcagacatatggcaaagcaatgtgttattggatttatataatggtgagaaataaaaaaaaaaaa

SEQ ID NO: 305761 - DNA, 172 bp, Homo sapiens
atcatatacaaaaacttactttttctaataaatttcttttcagcaatggagacaaaactgattatttaacggtagaccaattagtgagctttctaaatgaagtaagctttttcatacattaactccataaagtctgtgtgcagtggcttgccttctctggtgtcctcattgc

SEQ ID NO: 305762 - DNA, 355 bp, Homo sapiens
aaaatactgcatatatcaatgtccccattttcttttagcatcctttttctctaaaagtgcttatgttctacccaagattgtgaacaaggtctgactacttggcagtggtttggtgtcatggattttccatttgtctttcacacagctgaccaagaggaggaagctcaccccgaattcaaatttggaaatgaactttctgctgatgacttgggtcacaaggaagctgttgcaaatagcgtcaagaaggtcagagtcccctttctttcatcactctcaagaggtagcagctgttatttatgaaattttggaaatgtgagaaccacaagagaataaagtaacctataattccccttct

SEQ ID NO: 305763 - DNA, 590 bp, Homo sapiens
tttatttattcagagatactttatttattcagagatactttcgtattcttaaaaacaaacaaatatagatgtcagcaatatgccagatattagatcacaggattagatccccaattcccaggccccactctgtcactgatatgtctaagatcaaggaaagtggctttatttctcatccattatatgggtggggacaaggatcaatcacaagggttgaagtggtaatctttaacattcatttcatctaacatttttcacgagataatttccaggaaacatgttccaattgcttttctcagtgtcttgggcactgtagctcatgcagtacattttggggaatgcagatggatcatggacttactttcaacatcagggaacatttaagaacagcatggatttggtccacactccttagagtcatggttcttgggcgctgcattggaaaaatcagtgaaagtcctgttctgtttgcaggtgatcctgccggacctggctgtcttgagaatagctgtgtatgatgataacaacaagctgattggccagaggatcctcccgcttgatggcctccaagccggatatcgacacatttc

SEQ ID NO: 305764 - DNA, 514 bp, Homo sapiens
cttgccatgaagcagtccaaagaaatggatcagttgaaaaaagtccagcttgaacatctagaattcctagagaaacagaatgagcaggtattttacctaaaatacgtaaaaacatgcaggcagctagccagctttgggatacacatgccatggcccacagtgaccagtggcttgcatattgtaattgaaaggtagatagaagaatttgttgcccattactatattttctccattatatccaaaaagaaaagaaagtaccagtttttggagcaggagcagaatctggctgtgccaaaaaaagaatatttggataaattatggggattatgtgaattctaagaatgaaattactaaaagtgagaggatgaaaaaaagagattacgaagtatttctccattttcatttagagttttataatttgcaaactataggcaagggatatgatgtttaaaagcaaatgagagaaaccacctattttcaaactcaatctgaaaacgaagtttaaaaacctccc

SEQ ID NO: 305765 - DNA, 836 bp, Homo sapiens
caaagtggatcccctgctgcaacggcgagccagatcctctcggcaggaggaatgtgtcaaagctgttcagacccaaggaataacctaaagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttttcataataaatgagactacacaacaa

SEQ ID NO: 305766 - DNA, 826 bp, Homo sapiens
gggcctgccacccgaccggttgagccccgcccccgcttttgggaacccccctgcgccgtcctgccccgcccgttcctacctcgggccgcgccccaagagggtctaaaactttccggcccgccccccgcattttttgtttttcattggccttgactttctgttgtgtaactcattcttctttgggtttattttcatttgtttctgctgaatattatttgtttcaaactaaaaataacattccacattttaattgatgtgcggactcttaatctacttaaaatgtgggctgaagttccatgattccagctagtctggaataggtcatttaactggatgttaattcacctacattgttccctaagtgacatgtgggtcccattctgctgacatatttgtgggtcctggtaacaaccatttgggtagatttgctgattcctcttttctccttagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacaggtaagggaggaaaacacagaagggggaatataaaacaaaggcttcaaaattgaagggtgtgaaatgtcacactcattggtaacaggatcagcagatggtcctagatcctccttggtccccagtctactcattttcttatcaccagcaccctcaccccaactacttgtttcagaaaggatttgagactagttatcagttactaggtctgcccagaacttttt

SEQ ID NO: 305767 - DNA, 454 bp, Homo sapiens
  misc_feature (417)..(420): n is a, c, g, or t
  misc_feature (427)..(427): n is a, c, g, or t
accccaaacgcagagaggagtattccttggtcaacgcgagaacctctctggtttcctctctgcgtttggcagagaggaggatgcagaaatcattgtcaagatctttgtggagttttccatagcctctgagactcataaggccatccaggccctcaatggccgctggtttgctggccgcaaggtggtggctgaagtgtacgaccaggagcgttttgataacagtgtcctctctgcgtttcaaacgcagagaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaannnnataccantcctctctgcgtttgggggatcgtgat

SEQ ID NO: 305768 - DNA, 2521 bp, Homo sapiens
cgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttttcataataaatgagactacacaacaa

SEQ ID NO: 305769 - DNA, 2562 bp, Homo sapiens
cgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttttcataataaatgagactacacaacaatattgtatgtatcccagtaatctttgcatttctcaaaaaaa

SEQ ID NO: 305770 - DNA, 2828 bp, Homo sapiens
  misc_feature (2528)..(2528): n is a, c, g, or t
  misc_feature (2530)..(2530): n is a, c, g, or t
  misc_feature (2536)..(2536): n is a, c, g, or t
  misc_feature (2545)..(2545): n is a, c, g, or t
cgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttttcataataaatgagactacacaacaaaaaaaananagaaanaaaaaaaantttttgggccgcctcgtggccttgaaaaagttttttaaaacccttctgtttggggggcccgggcccccgttgggttacgttaacacctggggcaaaaagggggtacccaaaggaaaaacctcggggacagaacaaagggcctgggtgttttctccacccaatataaaaaaagccccggggggaaacccgaaggtttccggaaccaaatccccaaaggggatttccgagaggccataaggggggtctctacaaacaggggttccaaggaatccgattttaattc

SEQ ID NO: 305771 - DNA, 2073 bp, Homo sapiens
ctgcattgtttttcttataccatacaggtttttcattggccttgactttctgttgtgtaactcattcttctttgggtttattttcatttgtttctgctgaatattatttgtttcaaactaaaaataacattccacattttaattgatgtgcggactcttaatctacttaaaatgtgggctgaagttccatgattccagctagtctggaataggtcatttaactggatgttaattcacctacattgttccctaagtgacatgtgggtcccattctgctgacatatttgtgggtcctggtaacaaccatttgggtagatttgctgattcctcttttctccttagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttttcataataaatgagactacacaacaa

SEQ ID NO: 305772 - DNA, 2382 bp, Homo sapiens
  misc_feature (181)..(181): n is a, c, g, or t
  misc_feature (187)..(187): n is a, c, g, or t
  misc_feature (191)..(191): n is a, c, g, or t
  misc_feature (197)..(197): n is a, c, g, or t
  misc_feature (199)..(199): n is a, c, g, or t
  misc_feature (201)..(202): n is a, c, g, or t
  misc_feature (213)..(213): n is a, c, g, or t
  misc_feature (217)..(219): n is a, c, g, or t
  misc_feature (227)..(228): n is a, c, g, or t
  misc_feature (233)..(233): n is a, c, g, or t
  misc_feature (238)..(238): n is a, c, g, or t
  misc_feature (241)..(241): n is a, c, g, or t
  misc_feature (246)..(246): n is a, c, g, or t
  misc_feature (248)..(250): n is a, c, g, or t
  misc_feature (253)..(253): n is a, c, g, or t
  misc_feature (255)..(255): n is a, c, g, or t
  misc_feature (257)..(258): n is a, c, g, or t
  misc_feature (260)..(261): n is a, c, g, or t
  misc_feature (264)..(265): n is a, c, g, or t
  misc_feature (269)..(270): n is a, c, g, or t
  misc_feature (275)..(276): n is a, c, g, or t
  misc_feature (278)..(278): n is a, c, g, or t
  misc_feature (280)..(280): n is a, c, g, or t
  misc_feature (284)..(285): n is a, c, g, or t
  misc_feature (288)..(290): n is a, c, g, or t
  misc_feature (294)..(294): n is a, c, g, or t
  misc_feature (296)..(296): n is a, c, g, or t
  misc_feature (303)..(303): n is a, c, g, or t
  misc_feature (308)..(308): n is a, c, g, or t
  misc_feature (311)..(313): n is a, c, g, or t
  misc_feature (315)..(316): n is a, c, g, or t
  misc_feature (318)..(318): n is a, c, g, or t
  misc_feature (320)..(320): n is a, c, g, or t
  misc_feature (325)..(325): n is a, c, g, or t
  misc_feature (327)..(328): n is a, c, g, or t
  misc_feature (333)..(334): n is a, c, g, or t
  misc_feature (337)..(338): n is a, c, g, or t
  misc_feature (342)..(342): n is a, c, g, or t
  misc_feature (347)..(348): n is a, c, g, or t
  misc_feature (352)..(353): n is a, c, g, or t
  misc_feature (356)..(356): n is a, c, g, or t
  misc_feature (360)..(361): n is a, c, g, or t
  misc_feature (363)..(363): n is a, c, g, or t
  misc_feature (365)..(365): n is a, c, g, or t
  misc_feature (368)..(368): n is a, c, g, or t
  misc_feature (370)..(370): n is a, c, g, or t
  misc_feature (378)..(379): n is a, c, g, or t
  misc_feature (381)..(381): n is a, c, g, or t
  misc_feature (413)..(413): n is a, c, g, or t
  misc_feature (428)..(430): n is a, c, g, or t
  misc_feature (436)..(437): n is a, c, g, or t
  misc_feature (441)..(441): n is a, c, g, or t
  misc_feature (445)..(445): n is a, c, g, or t
  misc_feature (452)..(452): n is a, c, g, or t
  misc_feature (455)..(455): n is a, c, g, or t
cggggacaggggcgcgggccgggcccgatgacctcagagccccttcccgcagcgctcgcctggttctcgaggcccgctgcggcagaggaggaggagcagcagggagccgacggggccgctgccgaggacggggcggacgaggccgaggcagagatcatccagctgctgaagcgagccaagnggaggngggngaagtngngnnttatgagagangagnnngaggaggnngagtnaattntgngtggngnnnttngngnngnntanngggnngatgnnangngggnnatnnnttgngnttatganttggnggnnnanntngnatttntnnggggnnggnntganaatgnnggannacntttnnangnganantgggttgnntncttggggggggcatgaaggagggggggaatgnaataattgggatttnnntagagnnggcnggtntctatgntgngcagaacacaggaatttgctgttgctggctatgaattctgcatttcaactctagaggaaaaaattgaaagagaaaaggaattagcagaagacattatgtcagtagagacggggtttcaccatgttagccaggatggtctcaatctcctgaccttgtgatccacccgcctcggcctcccaaagtgctgtgattacagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttttcataataaatgagactacacaacaa

SEQ ID NO: 305773 - DNA, 1665 bp, Homo sapiens
cgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggatgtgagtgggactgataaactgatacttttggttcgtatgtacatactggaagaatcttttcataataaatgagactacacaacaa

SEQ ID NO: 305774 - DNA, 1392 bp, Homo sapiens
cgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagctgccaccacagtgcttggtccttccaaggaagctaaggccacgttgggatgaggccctcacttcatccggcaactaccaccacgtccggcagcgccagccccacacttgcccataccatgtcctctgtctccgagctcgcctgcatctactcagccctcactctgcatgacaatgaggtgaccatcacggaggataagatcaatgccctcgttaaagcagctggtgtaaatgttgaacctttttggtccagcttgtttgcaatggccctggccaatgtcaaca

SEQ ID NO: 305775 - DNA, 1409 bp, Homo sapiens
cgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcaggtaggaaacccattatctgggcattgccttttctccacaaaaggctttactttacacttttgagaaatggaaagagatctaaattgggaagagggaaagttacctattttgcaaaataagtgtctgtctttaaggtatcagcagaagttttggaataagatgttttatttaaaatatttgactgctgttttggtggtggttttttttttaacccccttggtaacatggtcataatttatttgttaacttttagttacatataacttaaggaaaattggggagcagaaggagaaggtgtttctcgtatctcttagttcagctaccaatcaaaatgcttattacgttttagccctagatatacagcaaattaagaaagaagagaaaaaaagctcatgtttttacaatccatcctcactcattctggaggctaggaatagaactggatgagcaggaagctctctagctctccaccattttgggtttcttaatttgggttgaagtattgagaattttcagatttgacatttattcaatacctactctataccaagagctaccgagatggtagggatacagcagtcaactcttctgtacctagtggtcttctaactctctcttg

SEQ ID NO: 305776 - DNA, 170 bp, Homo sapiens
atggccaacttagcatttatacggggtcagcttgaaaatgtaagtaaattgctttgtaatatcttgaatttatgaaggagtagcttcaagggaactgtaatagtaagagtacaggctaagctgctataacaaagagaccctagaatatagtgactcaaacaagataaaag

SEQ ID NO: 305777 - DNA, 336 bp, Homo sapiens
ctctgcatgacaatgaggtgaccatcacggaggataagatcaatgccctcgttaaagcagctggtgtaaatgttgaacctttttggtccagcttgtttgcaatggccctggccaatgtcaacattgggagcctcatctacaatgtaggggctggtggacctgctccagcagctggtgctgcaccagtgggatcctgcccactccactgctgctgctccagctgagaagaaagtggaagcaaacaaagaagaatctgaggagtctgatgatgacatgggcttttggttgttttgactaaatttcttataacgtgttcaatacaaagctgaacttaag

SEQ ID NO: 305778 - DNA, 691 bp, Homo sapiens
gcaccagcttgtcgcttcataagcacacagtaaattagccctatatctgcattcatgctctctcttcagaatcaccttgaaaacatacactttcttcttactgtcccttctctctgggttattttagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaa

SEQ ID NO: 305779 - DNA, 179 bp, Homo sapiens
gcggccgcctactactactactgctcgaattcaagcttctaacgatgtacggggacatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305780 - DNA, 1750 bp, Homo sapiens
gtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305781 - DNA, 2157 bp, Homo sapiens
cagtatgcatttttacagtttccctctcttagtcctcacagtgatacattctttgtattcaaacatttggggaaactggcactcagagaggttttaagttgcccaaggtcccagagcctgtaatcaacaaggtggggattaaaatccaggtctgacaaagcccttgatctctctgctgctctgtagatcagctgatgtagcctggtggctcctcgtagcaacatgtgaccttagaaggaggcacatgtgagacgaagtctttaattcaggcatgcattcattcattgagtgccaagtgacaggtattttatggtgatgccatactcagagcttgcagtctagctagcaataccaatttcattttactgagagcttatgatgtgcccagcactgcactgaatgctgaattgagtcacacacaaccccctaagcaacgggatgaagcaggagcacgtttctctccgtgtaaccggtaaagatactgatgctaagagaagctaaggagctggcccaagaaacccagccagcacgtggcaaggcccacgcagaatccagcccaagcccctggacccagccaccactccgctgcctgcactcagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305782 - DNA, 1654 bp, Homo sapiens
gtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305783 - DNA, 1617 bp, Homo sapiens
ttcctgaggctcaggcatcttgagaaaagaaggtgtggacagagcagaaggtcatggcagagcactccagcaggcagaggtttctgtccacagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305784 - DNA, 2252 bp, Homo sapiens
cagtatgcatttttacagtttccctctcttagtcctcacagtgatacattctttgtattcaaacatttggggaaactggcactcagagaggttttaagttgcccaaggtcccagagcctgtaatcaacaaggtggggattaaaatccaggtctgacaaagcccttgatctctctgctgctctgtagatcagctgatgtagcctggtggctcctcgtagcaacatgtgaccttagaaggaggcacatgtgagacgaagtctttaattcaggcatgcattcattcattgagtgccaagtgacaggtattttatggtgatgccatactcagagcttgcagtctagctagcaataccaatttcattttactgagagcttatgatgtgcccagcactgcactgaatgctgaattgagtcacacacaaccccctaagcaacgggatgaagcaggagcacgtttctctccgtgtaaccggtaaagatactgatgctaagagaagctaaggagctggcccaagaaacccagccagcacgtggcaaggcccacgcagaatccagcccaagcccctggacccagccaccactccgctgcctgcactcagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcaggtgtcacagcctaggctcttgggagtgccttggtttgggagtcccaacagctccaccccagggagcagcccttgaatagcgccacaagagtcaggggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305785 - DNA, 2498 bp, Homo sapiens
gtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaaggtaactgtcctgtcttcttcttcctgacgctcaccctacatagcaccaagtgcaaagccaaggagctcaaagccaccacgatcctccacacgggggagttatcttacccaaacctgtcgtggatcagaaaggttttagttctcggagatgaaattgagtctgggaaagggacgctgcatctccagaggtgaataattccctgaaactaaaaccattgcccgttttctctgattgatggttgctgatatcccctgaagttagttccacacccgaaacccaagccctctggccacttctgcccaggaaatgagagagggcatgcgattcccttggccatgtggccccagctgacatgagactggtcagggatgaaggtgagcaggaaggccctgcctgtgaaattcctggctgagctgattgctgccattgctctagtaggaagtcttgttcctggagcagtgagtattttgtgtctagaatctgatgtggcaaaccaaacatactgcagtttggagcacttggcatcataaaggaagagttctgggcagtgggtgagaaggaattaagggagtggacaccctaagccaccaaagcttccctcctaatgcttccctggctgaagcacaggctccttcccacatctccctccctctaaaagccccagaacccaaccacacagatccgtccatcactcagagatggacaggaaaggtgaggcaggattgttgatggctgctgtcttgcccagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305786 - DNA, 1633 bp, Homo sapiens
gtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcagtccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305787 - DNA, 2030 bp, Homo sapiens
gctaccttccctgtcccacgccacctgacacaaagcctctcacattgggaaaggcacggaacaaagaaatatgccaagccttgcacaacactgactcttaagacctaaggcaagacataaagttgtaggcagtgccacctaccagctccagacattaacacagctttcttgtttgccagtgaaatgcacccaaaacctccacagctactttgcagagagactctactatgccatgaaggtaactgtcctgtcttcttcttcctgacgctcaccctacatagcaccaagtgcaaagccaaggagctcaaagccaccacgatcctccacacgggggagttatcttacccaaacctgtcgtggatcagaaaggttttagttctcggagatgaaattgagtctgggaaagggacgctgcatctccagaggtgaataattccctgaaactaaaaccattgcccgttttctctgattgatggttgctgatatcccctgaagttagttccacacccgaaacccaagccctctggccacttctgcccaggaaatgagagagggcatgcgattcccttggccatgtggccccagctgacatgagactggtcagggatgaaggtgagcaggaaggccctgcctgtgaaattcctggctgagctgattgctgccattgctctagtaggaagtcttgttcctggagcagtgagtattttgtgtctagaatctgatgtggcaaaccaaacatactgcagtttggagcacttggcatcataaaggaagagttctgggcagtgggtgagaaggaattaagggagtggacaccctaagccaccaaagcttccctcctaatgcttccctggctgaagcacaggctccttcccacatctccctccctctaaaagccccagaacccaaccacacagatccgtccatcactcagagatggacaggaaaggtgaggcaggattgttgatggctgctgtcttgcccagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305788 - DNA, 1733 bp, Homo sapiens
gtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305789 - DNA, 988 bp, Homo sapiens
acagccgccactgccgagccaggcacaagcaaaccccttctcacgcttatgcgcctcctgcccacaggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305790 - DNA, 1332 bp, Homo sapiens
gctaccttccctgtcccacgccacctgacacaaagcctctcacattgggaaaggcacggaacaaagaaatatgccaagccttgcacaacactgactcttaagacctaaggcaagacataaagttgtaggcagtgccacctaccagctccagacattaacacagctttcttgtttgccagtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggagtggaactgtctctgattcattttccacatcaatcctgcatgtagttggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcagtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305791 - DNA, 1162 bp, Homo sapiens
cgggcagtgcaccttgatgctgctggtcgatctagagtatccccgagggtccctgcgcgcagtgccactcacctgctgagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcagtccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305792 - DNA, 1521 bp, Homo sapiens
gtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcagtccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaa

SEQ ID NO: 305793 - DNA, 253 bp, Homo sapiens
ggcagcagggatgatgtgagcagctttgtggacccggcactggccctccaagacgcacaggtgaggctgcgcccagccggccatgtggccccaccccctgccatctggactccggctcctctgcccacgggggctttctctgacactgggctgggacccacccagctcagctccctataggcctttgtcctgtggtgtctggggaggagagtgagggtgttgggagactcgggaggaaggagtgtgacttggg

SEQ ID NO: 305794 - DNA, 1738 bp, Homo sapiens
agcgggctgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggagctggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctg

SEQ ID NO: 305795 - DNA, 1772 bp, Homo sapiens
tcccccccccccccccccccccccccccccccccctctcccctcctcctccaactccccccaacttcggctaggtcgaggcctgggttgttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggagctggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagacgacagtgaaggagtcagccacagaggagaagctgacccctgtgttgctggctaaacagctggcagccctgaagcagcagctggttgcttcccacctggagaagctgctgggaccagatgctgcaatcaaccttaccgaccccgatggcgccctggctaagcgcctactactgcagctggaagcaacaaagaacagcaaagggggatcagggggaaaaaccactgggacccccccagatagcagccttgtcacttatgaactacattctcggcctgagcaggacaagttctctcaagctgccaaagtcgcagaacttgaaaagcgcctgacagagctggagacagctgtacgttgtgatcaggatgctcagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctg

SEQ ID NO: 305796 - DNA, 1366 bp, Homo sapiens
agcgggctgctgtcgcgagacttcctgctcatctgccgctccctttgccgccgccttagcccgggacccgaacccagcctctcccctacccgaacaccggccccggctccaccgaggcccgggtcccccagcccgtctcgccgccgccatggcggaccctaaatacgccgaccttcccggcattgccaggaatgagccagatgtttatgaaactagcgacctacctgaggatgatcaagcggagttcgatgcggagctggaggagctgacaagcacaagtgtggaacacatcattgtcaatcctaatgctgcctatgacaagttcaaggacaagagagtggggacaaagggacttgatttctcagatcgtattggaaaaaccaagaggacaggatatgaatctggagaatatgagatgcttggagagggtctgggagtgaaggagacaccccagcaaaagtaccagcgcctactgcatgaggtccaagagctgacaactgaagttgaaaaaatcaagaatcccctttctgcaggtctacagggagcctgtctcatggagactgtagagctgttgcaagcaaaggtgagcgccctagaccttgcagttttggatcaagtggaggctcggctacagagtgtcctgggaaaggtgaacgagattgccaagcataaagcctctgtagaagatgcagatacacaaagcaaggtgcaccagctatatgaaactatacagcgctggagccccattgcctccaccctccctgagctggtgcagagacttgtcaccatcaagcagctgcacgagcaagccatgcagtttggtcagctcctgacacacttggataccacccagcagatgattgctaattccttgaaggacaataccaccctcttgacccaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctg

SEQ ID NO: 305797 - DNA, 429 bp, Homo sapiens
tctagaggatcccgggactgagagtaaaggagaatgttaagtggcaggaggaaagtccccttgggcttatggggaggggaggaaagggctcccacttgtctgcatctgtggttgtttgctagggtgagggtctgtctgaggccagacacagaggggcctttcatccttccccttctcagaagcccagttagtgtcttagctctttggaccccatctccctggattctccctgatcgacctatcctgattatttttcctctctcattctcagatcctgccactctaggcaaatcctgcttctcctgtgcccactaacgcccgcacgcccccatcttcatgggatacaacttatccttcttctgaccctgtggcacttccttgcaccttcccattatcaccgcagctcctgtgctgggtagactttctctc

SEQ ID NO: 305798 - DNA, 2353 bp, Homo sapiens
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305799 - DNA, 2353 bp, Homo sapiens
gtaccggccggagtgtatggatccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305800 - DNA, 2083 bp, Homo sapiens
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305801 - DNA, 1950 bp, Homo sapiens
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggaggggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305802 - DNA, 2650 bp, Homo sapiens
  misc_feature (2363)..(2364): n is a, c, g, or t
  misc_feature (2366)..(2366): n is a, c, g, or t
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgtaaacaacaacnnanaaaaaaaggggggggcgaaaaaatacccgggggccaaaagggacccgtttttgtcaagggggccctatggggagggagataaagaaggacggggggggtaaaaagagggaggggaaggagcggggattgggagaccctcgtgtgggggaatggcaccaccaggattagccgggactacttcgttcgggtaacggcatgcggaatgtcgagatataggaggataataagagggtaaggatgatatgaagggagagtgcgagagtagacaacagcgtaacgacgag

SEQ ID NO: 305803 - DNA, 2151 bp, Homo sapiens
ctaaactttatttttttctcccccttttccagcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305804 - DNA, 2031 bp, Homo sapiens
  misc_feature (16)..(16): n is a, c, g, or t
  misc_feature (28)..(28): n is a, c, g, or t
aagcttacggctagtncgaggctgggtnttaatccggccgaggctagagcccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305805 - DNA, 1787 bp, Homo sapiens
gaacgggtgatgcggttgactgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtgggcatctatgtaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305806 - DNA, 1343 bp, Homo sapiens
ccggtaccctgctccgccctctccaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305807 - DNA, 2077 bp, Homo sapiens
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggagatccgcccgcacatccgcttattgtacacacatccgg

SEQ ID NO: 305808 - DNA, 2230 bp, Homo sapiens
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgaggaagaagatgaggacagtgactctggatcagatgaggaagagggagaagctgaggcttcctcttccactcctgctacaggtgtcttcttgaagtcctgggtctatcagccaggagaggacacagaggaggaggaagatgaggacagtgatacaggatcagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305809 - DNA, 1626 bp, Homo sapiens
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgagcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305810 - DNA, 1699 bp, Homo sapiens
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtatcggccaggagaggacacggaggaggaggaagatgaggatgtggatagtgaggataaggaagatgattcagaagcagccttgggagaagctgagtcagacccacatccctcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305811 - DNA, 1534 bp, Homo sapiens
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305812 - DNA, 1052 bp, Homo sapiens
tattagaggatccccagaggcacaagggaggaggggcatcctcaccgctcgccgtagtgtggatgacctgtggtggagaagaacagagaaagaagttgcagaagcaggccacatcgaaaggaggtgcaataggggcagtgcacaaagatggagtcaagtgctggagaaagccgaggatgaaagagaagctgagacttctgcttccacaccccctgcaagtgctttcttgaaggcctgggtgtatcggccaggagaggacacggaggaggaggaagatgaggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305813 - DNA, 803 bp, Homo sapiens
  misc_feature (16)..(16): n is a, c, g, or t
  misc_feature (28)..(28): n is a, c, g, or t
aagcttacggctagtncgaggctgggtnttggatgtggatagtgaggataaggaagatgattcagaagcagccttgggagaagctgagtcagacccacatccctcccacccggaccagagggcccacttcaggggctggggatatcgacctggaaaagagacagaggaagaggaagctgctgaggactggggagaagctgagccctgccccttccgagtggccatctatgtacctggagagaagccaccgcctccctgggctcctcctaggctgcccctccgactgcaaaggcggctcaagcgcccagaaacccctactcatgatccggaccctgagactcccctaaaggccagaaaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305814 - DNA, 1418 bp, Homo sapiens
  misc_feature (1387)..(1387): n is a, c, g, or t
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctcagccccagcccagaggccccagctcaagtcctggtggtgccaacccagtgatgaagaggagggtgaggtcaaggctttgggggcagctgagaaggatggagaagctgagtgtcctccctgcatccccccaccaagtgccttcctgaaggcctgggtgtattggccaggagaggacacagaggaagaggaagatgagaatctagccacggaggataaaagaacagaaagaagtaaaggagccaggaagacctccgtgtccccccgatctcagnctccgaccccagtcctgggatatcttcatga

SEQ ID NO: 305815 - DNA, 1136 bp, Homo sapiens
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagcacttgggtgtcttgcccaggggaggaagagaatcaagccacggaggataaaagaacagaaagaagtaaaggagccaggaagacctccgtgtccccccgatcttcaggctccgaccccaggtcctgggagtatcgttcaggagaggcgtccgaggagaaggaggaaaaggcacacgaagaaactgggaaaggagaagctgccccagggccgcaatcctttcccagtttctttgtgtgccg

SEQ ID NO: 305816 - DNA, 959 bp, Homo sapiens
tcggctcttatcggttcccatcccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccgcccagacacatggccccaggccaagcaccccatcaggctaccccgtggagggatgcccaccctttcttcctcctgtccccagtgatgggcctcctcagccgcgcctggagccgcctgaggggcctgggacctctagagccctggctggtggaagcagtaaaaggagcagctctggtagaagctggcctggagggagaagctaggactcctctggcaatcccccataccccttggggcagacgccctgaagaggaggctgaagacagtggaggccctggagaggacagagaaacactggggctgaaaaccagcagttcccttcctgaagcctggggacttttggatgatgatgatggcatgtatggtgagcgagaggcaaccagtgtccctagagggcagggaagtcaatttgcagatggccagcgtgctcccctgtctcccagccttctgataaggacactgcaaggttctgataagaacccaggggaggagaaagccgaggaagagggagttgctgaagaggagggagttaacaagttctcttatccaccatcacaccgggagtgttgtccagccgtggaggaggaggacgatgaagaagctgtaaagaaagaagctcacagaacctctacttctgccttgtctccaggatccaagcccagccaacttaggaaaattacctgccctcaggtgggtagggatatgattaattccagctcccttct

SEQ ID NO: 305817 - DNA, 565 bp, Homo sapiens
ctacgcggctggacaacactcccggtgtgatggtggataagagaacttgttaactccctccccatccggattcccgtggctgtgtgcatctcctgcctgtgtccccatgtctgcccgcaggtgcgcttctccgagaaggtcactgtccatttcctggctgtctgggcagggccggcccaggccgcccgccagggcccctgggagcagcttgctcgggatcgcagccgcttcgcacgccgcatcacccaggcccaggaggagctgagcccctgcctcacccctgctgcccgggccagagcctgggcacgcctcaggaacccacctttagcccccatccctgccctcacccagaccttgccttcctcctctgtcccttcgtccccagtccagaccacgcccttgagccaagctgtggccacaccttcccgctcgtctgctgctgcagcggctgccctggacctcagtgggaggcgtggctgagaccaactggtttgcctataatttattaactatttattttttctaagtgtgggtttatataaggaataaagccttttgatttgta

SEQ ID NO: 305818 - DNA, 583 bp, Homo sapiens
gtaccggccggagtgtatggatccagttgttgatcttatgcaagacgctgcacgaccccgcgcccgcttgtcgccacggcacttgaggcagccggagatactctgagttactcggagcccgacgcctgagggtgagatgaacgcgctggcctccctaaccgtccggacctgtgatcgcttctggcagaccgaaccggcgctcctgcccccggggtgacgcgcagctcccagccggtgagtaaggggtcggaacgcctgggtccccacggggctgggggcccggatttagaaaggagaaggggttgggagcctggagtcctgagcctgagggaggagggatctggaagccagattcttgggtcccccgtgaaggaatcatctgccaagtagggggtcgggtcagaatgtttcagtctgcgagggaggagggtgtgagggtttgatttgtcaatcttcagcagaatgagagagctagggactatgactttgtcgccaagggaagcaagtaaagacttttgttcttggttcttgggactgggagttctgcgtctgaagaaagagagggctgggggcttggaccctt

SEQ ID NO: 305819 - DNA, 525 bp, Homo sapiens
caaactcctgacatcacgtgatccacccatctcagcctcccaaagtgctgggattacaggcgtgagctaccacatctggctgagagcccagattcttgagtcttagaaagaaagggggctgggggccgagacttctgggtccctgtatgttgcagagggttgcatgtcatctccatggagaaggctgtgtacgctgtcacgcaatcccttgtaagaggccaggcccctgggggaggagggagcagctgtggctcacagcagccccaggaaaccacctcttccttcagtgagtcagatagatagagaatcccgtgacagtgacaggcaagtgactagccagatagaaagcatttttgtgtaataactaatttttgtttgcttctctctctctcttccccgccctccccatccggattcccgtggctgtgtgcatctcctgcctgtgtccccatgtctgcccgcaggtgcgcttctccgagaaggtcactgtccatttcctggctgtctgggcagggccggcccagg

SEQ ID NO: 305820 - DNA, 357 bp, Homo sapiens
ctcctgggcacagcaataaactcctgcctgggtttcacttagtgcccacaccttacagtgccttgcataccacagatgctcaatacacagttactgcatatctgttgaatatgtgttggcaacactggatcaagcacctcagatgtccactgatcaccttagtattcaaaagtacagagaggctgggtgcgtgcggtggctcatccctgtaatcccagcactttgggatgccgaggcaggcagatcacttgaggtcaggcatttggagatgagcctgaccaacatggtaaaaccccatctctactaaaaatacaagaaaattagccaggggtggtggtgcacgcctgtaatcccagc

SEQ ID NO: 305821 - DNA, 569 bp, Homo sapiens
attagtgatggattgctttgtaatactttgggagtctgggtttggcagagtgtgcccctatgaagactaagtgggactataatgattgtgttttcttaaatcagaatcaggatgcataaccagatgaaggaagacatagtcgggagccatagttttaatatctagattttggaattttagggtgatttactatagggacaaagtatttgaaattgggattggcggaacatcagtggaaccagcgattgctaagttaaatatatacagggacattagataatggatgatgaggaaatgggtaaaagaaagtgagggccttgtgagttgaaacaaaaataatcaaacctggaacactttccatttattgtattagatatcttcatttcaataaaattaatgtatatgacaaaattttattgtcctcctagttcaagtggtattctacttttatttccataaaaatatactttcaggatagggaaagggtaaacttgcattataagtttgtattttctcacgaagggacaggagagaagaaaaaaatcatttgcttattgtctaggctatgc

SEQ ID NO: 305822 - DNA, 716 bp, Homo sapiens
ccaccttggccaagctggtctcaaactcccaacctcaggtgatccacccacctcggccccaaagtgctgggattacaggagtgagccactgcttccggcctgctgtatgtttttattatatactatgagataatgagattagtgatggattgctttgtaatactttgggagtctgggtttggcagagtgtgcccctatgaagactaagtgggactataatgattgtgttttcttaaatcagaatcaggatgcataaccagatgaaggaagacatagtcgggagccatagttttaatatctagattttggaattttagggtgatttactatagggacaaagtatttgaaattgggattggcggaacatcagtggaaccagcgattgctaagttaaatatatacagggacattagataatggatgatgaggaaatgggtaaaagaaagtgagggccttgtgagttgaaacaaaaataatcaaacctggaacactttccatttattgtattagatatcttcatttcaataaaattaatgtatatgacaaaattttattgtcctcctagttcaagtggtattctacttttatttccataaaaatatactttcaggatagggaaagggtaaacttgcattataagtttgtattttctcacgaagggacaggagagaagaaaaaaatcatttgcttattgtctaggctatgcaaaaaaaaaa

SEQ ID NO: 305823 - DNA, 1890 bp, Homo sapiens
  misc_feature (1)..(2): n is a, c, g, or t
  misc_feature (161)..(161): n is a, c, g, or t
  misc_feature (366)..(366): n is a, c, g, or t
  misc_feature (934)..(934): n is a, c, g, or t
  misc_feature (1150)..(1150): n is a, c, g, or t
  misc_feature (1388)..(1388): n is a, c, g, or t
nnaatgtcaggattgaaaatattaactatatgtttaactttcagtgtttcatacttcccttaagagatgtaccactgaatgcttagaaacctgattttaaataggtatattttttaaaggagacttaagagcgatatcaaaaaatcacattcagcattttnaatgcactatttctaagaatgttttgttgaattatatggtagaagactttttgtattatgaatacccatgggcaaattggaagcataaacttggattttctcatgtttaaatgacttaaagacaagttgtatatttttattcattgttacagatttgtttcctcttcatgataaatttatgtgcaggtctgattgtacagtttanagtttggtctacattttgtttcttcctggctgagcacctctgtgttgagtgctaatagcttttttttttaatctaggttaactactgtgagatagtggggccccaatgaaacatataagcataccttttaaaatgttgccaaatagtcttcagagaacatacttaatacaaaaatgctgtgcagacatcattccgattgatcgactgatggatgactccgcagtttggattagagagagtaagaattagccagccagcatgatttgaaaatgtcacaggagggtgccagcaggatgatgtcagcccttgctttggcctatgcagcatagcacagtcatttcataaagaattgatactatgacacagggtgctggatgtgcattgggcacatctgtaattatagaactgagtttctgaatgagtcaaaacaaggtttagttagttcataatgttcaaaaatagctgtttttaaattagactctgctaatttaaattattgtttaaaaaattagcattttcagtggctgctttatattcctttagagcaatggcctacatgtttaatatngtcattttgaataggcattgctttttattcatgtaaagtctgtatttccctctatcttagtagcctggtaaaaactgaaccctgatttccagtattcagttgtttaaagattagtatattaactctgtatttttaagaaattttcccagtgaaagaattttctgaaaagaatgtcataggaaaatctaggctaatacttctctacacagcactcantatttgttattgctctacagagtaatttaagttatagagtccattgaatcttgtggctgggttggatattacccaaagctgcattcaaaggaagagcagtggtaatatctaaatatatagtttgaactatatatgtggacataacttacaaatattaaaataaaaggagtagtcatatatataaccaaacatttcctctgtactgaggtatattcagtattatactatgtacatttanaaagtaaccctgtaagttacactaatgcaggagtttgtatggaagtattgcatgttcgcaggatttcagaggcactttcttaataatgtgttaatggtgttaatgtctgttttatttattctttggatttttttgttttcatttttgggtttttgttgttgttacataaaataaaactatataaggctatttgtgccctatataaaatagctattttaaagagaattttaaagtgtcatattgtcttatgtgcccatgcatttatatagtggtcagaagtgtgtcttataaatagtaaaatcatgtagtaacgtcccctgtacctgagtttcagtgcagttaaggggcgtaattgcagggtcttttaatacacagtttactatctacaagtacttaccttagcaggcaattgtttttgttttttctttttttaaaaaaaaaagtatggtaaaccttcatactttagttttacaaagtaataataaactgttttgatattaac

SEQ ID NO: 305824 - DNA, 2809 bp, Homo sapiens
  misc_feature (1)..(2): n is a, c, g, or t
  misc_feature (161)..(161): n is a, c, g, or t
  misc_feature (366)..(366): n is a, c, g, or t
  misc_feature (934)..(934): n is a, c, g, or t
  misc_feature (1150)..(1150): n is a, c, g, or t
  misc_feature (1388)..(1388): n is a, c, g, or t
nnaatgtcaggattgaaaatattaactatatgtttaactttcagtgtttcatacttcccttaagagatgtaccactgaatgcttagaaacctgattttaaataggtatattttttaaaggagacttaagagcgatatcaaaaaatcacattcagcattttnaatgcactatttctaagaatgttttgttgaattatatggtagaagactttttgtattatgaatacccatgggcaaattggaagcataaacttggattttctcatgtttaaatgacttaaagacaagttgtatatttttattcattgttacagatttgtttcctcttcatgataaatttatgtgcaggtctgattgtacagtttanagtttggtctacattttgtttcttcctggctgagcacctctgtgttgagtgctaatagcttttttttttaatctaggttaactactgtgagatagtggggccccaatgaaacatataagcataccttttaaaatgttgccaaatagtcttcagagaacatacttaatacaaaaatgctgtgcagacatcattccgattgatcgactgatggatgactccgcagtttggattagagagagtaagaattagccagccagcatgatttgaaaatgtcacaggagggtgccagcaggatgatgtcagcccttgctttggcctatgcagcatagcacagtcatttcataaagaattgatactatgacacagggtgctggatgtgcattgggcacatctgtaattatagaactgagtttctgaatgagtcaaaacaaggtttagttagttcataatgttcaaaaatagctgtttttaaattagactctgctaatttaaattattgtttaaaaaattagcattttcagtggctgctttatattcctttagagcaatggcctacatgtttaatatngtcattttgaataggcattgctttttattcatgtaaagtctgtatttccctctatcttagtagcctggtaaaaactgaaccctgatttccagtattcagttgtttaaagattagtatattaactctgtatttttaagaaattttcccagtgaaagaattttctgaaaagaatgtcataggaaaatctaggctaatacttctctacacagcactcantatttgttattgctctacagagtaatttaagttatagagtccattgaatcttgtggctgggttggatattacccaaagctgcattcaaaggaagagcagtggtaatatctaaatatatagtttgaactatatatgtggacataacttacaaatattaaaataaaaggagtagtcatatatataaccaaacatttcctctgtactgaggtatattcagtattatactatgtacatttanaaagtaaccctgtaagttacactaatgcaggagtttgtatggaagtattgcatgttcgcaggatttcagaggcactttcttaataatgtgttaatggtgttaatgtctgttttatttattctttggatttttttgttttcatttttgggtttttgttgttgttacataaaataaaactatataaggctatttgtgccctatataaaatagctattttaaagagaattttaaagtgtcatattgtcttatgtgcccatgcatttatatagtggtcagaagtgtgtcttataaatagtaaaatcatgtagtaacgtcccctgtacctgagtttcagtgcagttaaggggcgtaattgcagggtcttttaatacacagtttactatctacaagtacttaccttagcaggcaattgtttttgttttttctttttttaaaaaaaaaagtatggtaaaccttcatactttagttttacaaagtaataataaactgttttgatattaacatgttttaatttgtatagcactttatattcaagacattttacacatgtatttctgatttgacacttatttgttaaatgctttattttatctggctcatagtagaagactattacagtgacctgcagaaaaaaatattgactctgggcaactagtgagatttacaactttactattaaataagcttttttattacaactcttttgaaaccaaacatattgagatcatttcctttcgtagggcttaaatatgtatttcccaccttattttcctgttccatctactcatattgttgttaactaaatgttaaccatttaaataagtttcccttctttctctcttaatcagaagagaggggaaccatgctcagatcaaataggaatgtctgtttacacttttgtaatcagtcactttattatgttaattctagttctacctatgttgtaattttaatagaattcttcaagactctccaggtagggtatcattaatactgctaatttaatcctcttaaaatatttgccaggaaaggtatttctacagtttttatcatgtgttccaaccctaagtatctaaatttttattatgaccaaattttattatgaccaataatgatctttccatatttgtgttaatgataaaatattcctgtttgtagcttatacatatatacatattttttctaacctataatgcttttagaagttatcctaaaatccaacttgatattcatatgataaacagaattcagaaattaagaatttttaaaggggctgggtgtggtggctcacgcctgtaatcctagcactttgggaggctgaggtaggtggatcacttgaggccaggagttcaagaccagcctggcaacatggtgaaaccccatcttcactgaaaatacaaaaaattagccaggtatggtgg

SEQ ID NO: 305825 - DNA, 1734 bp, Homo sapiens
gtgccctcgtgctgcctaggagacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgg

SEQ ID NO: 305826 - DNA, 2200 bp, Homo sapiens
gtgccctcgtgctgcctaggagacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttggaaaaaacacagggacacaacgaagccaaaaaacgaaaacagaaaacaacaaaacgcacgaaacaaagaacgaacaacagaaaacaacacagcacgcaaggggacgggcgccgagaaacacaagaaaagaacccacgcgaggacgcacggaagaggacacgacagcacacccacgacacgccaggagcaagagagggcgaccaccacagccaccgcggccaaacacacagacgacaggactacaagacacgcgcacaggcgcagacaaacacacgcacggacagagaggaggaccggaagaggagaggagcgcgggagcgagagcgcgagagcggggggcgcacccaacacgacaggagagagggcagacaggcgccgggcgcacacagaggacgcgagagcggagctccgcagagagccgaggcgagacacacacgaaaaagcacgaaggaggccaagagcaacga

SEQ ID NO: 305827 - DNA, 2165 bp, Homo sapiens
gtgccctcgtgctgcctaggagacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttggaaaaacaaaaaacagctcaagaacgaaaaaccactatacagaacgcgaccaccaaacaagacaagaaacaccacaacaccaccacagcacacacagagaggggcgcgagccgagagagaagaagagaaagaaagagaggcgagggacaagagtaggaggcgcgacagaagaggacataggacacacaggggcgggcagtaacggcgaggcgccacgaaagacgagacgagccgagaggaggagcgggaggccagagtccagcagaacaagagaagggatggagggagagagcagaagaggagagggatgggcgatgagcggaggcagagaacgagacgagccgtctgtgtgcgaggactcgagacacatgacggtggggcagtgcacagactgaacgcgacgaaagacaggacgagagacgcgaggagaac

SEQ ID NO: 305828 - DNA, 1864 bp, Homo sapiens
gtgccctcgtgctgcctaggagacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccgggtctgctggagctcctgcccctgactgtccctccccccgggcttccttcctacccgagcccctggtggtgtgggggagggcgggccttgggagagcctcgactgagtgttgcctgatcctcctcctgcagtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgg

SEQ ID NO: 305829 - DNA, 1976 bp, Homo sapiens
gtgccctcgtgctgcctaggagacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcggagttggtggcggccgggatgcccacaaggaaggggtcattcttggcctgctccgtgcagaacttcagcagatcggcggccatctttggacacctgcagaccaactggttcagccagaccagacccaggcatgcacctgtcccctggcccatgtgttcccacctcttcccgcctcctgcactggccccgaccctcaccttcacttggtcgatgcctgcctccatctggagctgctccactgcccagagggcctgcccaatgtcactgttgatggccaccttgctggacatctgggtaaagtgggcaggccgtgggcagcaggcccaacctcagtcccctagggggagcctagggctgcccgagggttcccacacctccttctatgttccttgggggctgca

SEQ ID NO: 305830 - DNA, 1696 bp, Homo sapiens
gtgccctcgtgctgcctaggagacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggctcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgg

SEQ ID NO: 305831 - DNA, 1761 bp, Homo sapiens
caagataggtcaggtatgaggctggtgtgtaatcggagagggctgctagagatagagcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagagaagaactttgactggccggcagcctgcattgcgctggagcagcacctgtcccgctgggcagaggatgggcgctgggtcgaatacttctgcctggccgaaggccacgtggcttccgttgactcagtgctgctgctccagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgg

SEQ ID NO: 305832 - DNA, 1594 bp, Homo sapiens
gtgccctcgtgctgcctaggagacaagacgcgaggccggcagcgcccacccggtcgcaatggagcttcccctagggcggtgcgatgattcccgcacctgggacgatgactcggacccagagtcagagacagacccagacgcgcaggccaaggcctacgtggcccgcgttctcagtccgccaaaatccgggctggcgttctcgcgcccctcgcagctatccacacccgccgcgtccccgagcgcttcggagcctcgggccgcgtccagggtttcggccgtaagtgagccgggccttctgagccttcccccggagctgctgctcgagatctgctcctacctggacgcccgcctcgtgctccacgtcctgtcgcgggtgtgccacgcgctccgcgacctcgtgtctgaccatgtcacctggaggctacgcgcgctacgccgcgtacgcgcgccctacccagtggtggaagggtgggtcactctgtctgtcgggctcccgagatcgcaacgtcaacttgtgggacctgcggcagctggggacggagtccaaccaggttctgatcaagaccttaggcactaagcgaaatagtacccatgagggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgg

SEQ ID NO: 305833 - DNA, 1053 bp, Homo sapiens
  misc_feature (13)..(13): n is a, c, g, or t
cgcgctggacganccaccagtttgtcaggccttagcactaacgaatagaccttgaggctgggtgtggtcactggcagcgcaggaccaccgcgtgtgctccggctcctgggacagcacagtgaagctctgggacatggcagcggatgggcagcagttcggcgagataaaggccagctcagccgtgctgtgcctctcctacctgcctgacatcctggtgactggcacctatgacaagaaggtgaccatctacgaccccagagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcagctggactcctacctgctctgcatgtcctaccaggaaccccagctctgggctggtgacaaccagggcctgctgcacgtcttcgccaaccgcaacggctgcttccagcttatccggtcctttgatgtgggccacagctttcccatcactgggatccagtactccgtgggagccttgtacaccacatccactgacaagaccatccgggtgcacgtgcccacagacccaccaaggaccatttgcacccgaaggcatgacaatgggctcaatagggtctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgg

SEQ ID NO: 305834 - DNA, 237 bp, Homo sapiens
ggtctcccatctcagcccagctcagccatgccctgagaagtattcacttcatgtttattgaggccccctggtttgcccaggccacagggtggcattgccctgggttcataggatggcatagggcttcttctccttgaaggagttggtggcggccgggatgcccacaaggaaggggtcattcttggcctgctccgtgcagaacttcagcagatcggcggccatctttggacacctgca

SEQ ID NO: 305835 - DNA, 704 bp, Homo sapiens
agatgaaaagttttaggcagctaggaatgtggagatgtgggtagtggtggctgccaagcacaggaaaatgatcatgctgaactgtacaaaggagattgtctctgaaccttttcataggttctgacactctatatatgtcatcttatttaaaaccctctgtattaaaatgataaggatttggagacattgaaattatatagaatttaaatgtatgcatgttcatatgtttttgcctctggctcatatttccagaatacttaacagtattttaacattttgtttcttatgattctggtcctaaaaaatcaaggacgctgcttactcagaaagctaaaaaacctgagctccagacccagttcctggacctgccctggaaaagaagtatcccgtagagatgagctcactgcagttacttaattaacaatttgtaagctgcaaaaatggcaatgggccaaccaagaacagctacaatttgaatttttctatttccagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacaggtcagtgttcaatgatttctg

SEQ ID NO: 305836 - DNA, 4188 bp, Homo sapiens
cgacgagttcgagtttgagaccgtgctggtgcaacatatggagactccgtctctacagaaggtcttgaacatatatacagcgctggtggcacacacctgtagtcccagttactcagtagactgagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtg

SEQ ID NO: 305837 - DNA, 4143 bp, Homo sapiens
  misc_feature (38)..(39): n is a, c, g, or t
  misc_feature (41)..(41): n is a, c, g, or t
  misc_feature (47)..(49): n is a, c, g, or t
aacgggtgatgcggttgccctagagggagaggcggcgnngncggccnnngaggaggagggggaagcggcggcggcaaaggaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtg

SEQ ID NO: 305838 - DNA, 4126 bp, Homo sapiens
  misc_feature (30)..(31): n is a, c, g, or t
  misc_feature (38)..(38): n is a, c, g, or t
ctagagtatccccaactacagcagcaaccnngaacagntaaatttgaatttttctatttccagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtg

SEQ ID NO: 305839 - DNA, 4336 bp, Homo sapiens
  misc_feature (30)..(31): n is a, c, g, or t
  misc_feature (38)..(38): n is a, c, g, or t
ctagagtatccccaactacagcagcaaccnngaacagntaaatttgaatttttctatttccagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagatatttgaagaataagtaattcttggctgggcatggtggctcacgcctgtaattccagtgctttgggaggccaagatgggaggatcatttgagcccaggagtttgagaccagctggggcaacatatggagactccgtctctacagaaggttttgaaattatgcaggcatggtggcacacacctgtagtcccagttactcagtagactgagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtg

SEQ ID NO: 305840 - DNA, 4465 bp, Homo sapiens
cgacgagttcgagtttgagaccgtgctggtgcaacatatggagactccgtctctacagaaggtcttgaacatatatacagcgctggtggcacacacctgtagtcccagttactcagtagactgagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtgaaaaaaaacaacatgacaacagaaaatttgcgggcgccagcggtcccagaaaaaatttcgaaaacaacctggggcgggggccagatgtaatggaactgggccaaacgtgtcccaagaaactcgggcacaacatgtgctgggttccaccaaaaaaagccggcgccccggtctcgaaatccataggtgccgagacaccggcaacaagggccagggctcaacccaccgtgcgtgaagaacgagacaacaagacacccagatacacgagcacaccaacaca

SEQ ID NO: 305841 - DNA, 3538 bp, Homo sapiens
agcgatgatcgcattacactcgatagtccagtcgataatggaactatctaggccttttctcaacgacactcgccagagttatgctcccaattcatggctaattttagagtcgtattactccatgactgggccggtccttttcccaactcttgcctcatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtg

SEQ ID NO: 305842 - DNA, 3971 bp, Homo sapiens
cgacgagttcgagtttgagaccgtgctggtgcaacatatggagactccgtctctacagaaggtcttgaacatatatacagcgctggtggcacacacctgtagtcccagttactcagtagactgagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaa

SEQ ID NO: 305843 - DNA, 4049 bp, Homo sapiens
cgacgagttcgagtttgagaccgtgctggtgcaacatatggagactccgtctctacagaaggtcttgaacatatatacagcgctggtggcacacacctgtagtcccagttactcagtagactgagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttcccttgaagaaatgcagcagctgagaagttgtaatagacaactccagattgacattgactgcttaaccaaagaaattgatctttttcaagcccgaggaccacattttaaccccagcgctattcataacttttatgacaatattggatttgtaggtcctgtgccaccaaaacccaaagatcaaaggtccatcatcaaaacaccaaagactcaagacacagaagatgatgagggagctcagtggaattgtaccgcctgtacttttttgaaccatccagccttaattcgctgtgaacagtgtgagatgccaaggcatttctgagccaaatggccctgtatcttctctaaaaccacatctaaagttcaagaaactagtctgtcatcgggaaaaagtttcactgctacataggattttgtcaaattgaaggtgtgacaagatggtgttctgctaatgttaaatgtcagcccacagagctaataatacctcagtataatgtcatgagcagttgaaattcatcacatgaaaagtaatctgctgaaagacttggttgcccactgcctaactgtgtacagtgttaccagtgtcccattatggataattctcaatatgttaacacctaggtgttcccaatacctttttcccctcatgtcactactgaattttgacaggaggaaggaatagaatgatagcttgttttatttgtaaagctttcagtgaaacactacatacacgaagaaaaggaacaaggtttaactatttaagaaccatttgctgccgcatagtgccattggatagggaagaacttcagaaatctgtggtactcttggccttgtctttgtcttccctgaacgtgtctccactctgtgaagccagcatctaggggctaaagatgcaaaggaaagcagcatgcattgtctgtacaaatgtgcagcgaaataccccaaagcttttcctactgtacagatctctcgagtctgctttaagtgatttcttttcttcttgattattttcttatatttctatatgtatagtgtaatagccttttgttaactaattttcttttttccttttagtaattaagcacgatcatgtccctttttaagccttacctgagaggaacaatgccttaaaataaaaaagcattaatgagatgaaagtatgcacagaataactttcctctacttattctgtactttgccctcatgagttccaatgttgtgtgaagacaggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcaaaaaaaaaaaaaaaaaaaaaaaaaaaaatttttggggcggccttgggcccctggaaaaagtttccagagacccattcgcgttgggccccgggggcccatgtggggttagtggcacagggggccaagacggtgttcccgagaggaaaaaaccgggggacaacgacacaagggccgcggtgtttctccgcccgaaattaaaaaaaaggccgcggggggaaccaccgacgtcgtttctgacacactccccagagagggaattcgcgagaaggcacaaacgggggctctcatcaacagagaggacccaagagacccagaaaaaattc

SEQ ID NO: 305844 - DNA, 1052 bp, Homo sapiens
cgtgctattccgtgcatagctcgattcctagaggtataccctggttcagcgctcttggtgagggcatggcagatgctgcacagtgaattgcagatgatattacagaagtgatgtctgtaggtcacattaaatactgacttgagcagtgggtgacacaacacagtgtttgtcttccacagggaagcttaaaacaaaagatatttttaacccactgacagaacaacaaggttaagcttcatctgcttggtgtcccacagaacttgcacaagcagttgttattgggaaagtacagtctcaaaaccagcaacagcagcagtacctacagccctttttttggagagaagtttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtg

SEQ ID NO: 305845 - DNA, 760 bp, Homo sapiens
agcgcccactagctcattctaagcactcatataatttcataaattctgtctttttaaatgctttactgttggggcagtccatttctaatcctgacttggtgacagtatcatgtgtatttataaaacaaggctagccatatttaggacaactgaagaaaagctggaaaaaaaaacaagcaaacttgaacactgaagcaacctcaagcatctctttattttgatgatatatttttgtaaggaaaatattcagatgatcaggaatgtatataactgaaatcaagaaaaagaacagtatgcatttaaaaagacagaattatgaaattatatgagtgcttagaatggggctaagggaagtgctgaaatagagcaaaggatggaagataatatagactaccacccactgtaaatgtttgcaagtggctgtgttttaaatgggattattacagttgatctctatgaatgtcagagccctaactttcaggctttgcattttgtatatgggaagaaatatgacaatcctaggtaattaaaccatagacccaaagcccttacgtttgatgcaatttatttttaaaataggccttgtttttcagcttcatctgcagttctatgtgaagattgataaatcagtttttacttgttttattaataaaacgtaatttggatatcttgagttgatggttttgtgatttagctgggtaaactatctttgtaacagataagttatttataaaaattaaaaaacttatattctaatgtg

SEQ ID NO: 305846 - DNA, 2000 bp, Homo sapiens
cgacgagttcgagtttgagaccgtgctggtgcaacatatggagactccgtctctacagaaggtcttgaacatatatacagcgctggtggcacacacctgtagtcccagttactcagtagactgagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagccacagacagcaccagctcaagttcctcaaggctttaatgtttttggaatgtccagttcctctggtgcttcaaattcagcaccacatcttggatttcacttaggcagcaaaggaacatctagcctttctcaacaaactcccagatttaatcccattatggtaactttagccccaaatatccagactggtcgtaatactcctacatctttgcacatacatggtgtacctccacctgtacttaacagtccacagggaaattctatctatattaggccttacattacaactcctggtggtacaactcgacagacacaacagcattctggctgggtatctcagtttaatcccatgaaccctcagcaagtttatcagccttcacagcctggtccctggactacttgtcctgcatctaatcctctgtcacatacctcatctcaacagccaaatcagcaaggccaccagacctctcatgtctacatgccaatcagttcacctactacttcacaaccaccaaccattcattcatctggtagctcacagtcttctgcccatagccaatataacattcagaatatttcaacaggacctcgaaaaaaccagattgaaatcaaacttgaacccccacaaagaaataattcttcaaaactgcgttcttctggacctcgaacctccagcacttcctcttcagtcaatagccagaccttaaacagaaatcagcccactgtttacatagctgccagccccccaaatacggatgagctgatgtcccgtagtcaacctaaggtctatatttcagcgaatgctgccacaggagatgaacaggtcatgcggaatcagcccacactcttcatatccacaaactctggagcatctgctgcctccaggaacatgtctgggcaagtgagcatgggtcctgcctttattcatcaccatcctcccaaaagtcgagcaataggcaataactctgcaacctctcctcgagtggtagtcactcagcccaatacgaaatacactttcaaaattacagtctctcccaataagccccctgcagtttcaccaggggtggtgtcccctacctttgaacttacaaatcttcttaatcatcctgatcattatgtagaaaccgagaatattcagcacctcacggaccctacattagcacatgtggatagaataagtgaaacacggaaactgagtatgggatctgatgatgctgcctacacacaagctcttttggtacaccagaaggccagaatggaacgacttcaaagagaacttgagattcaaaagaaaaagctggataaattaaaatctgaggttaatgaaatggaaaataatctaactcgaaggcgcctgaaaagatcaaattctatatcccagataccttccgtaagtctttatgtaactgttg

SEQ ID NO: 305847 - DNA, 658 bp, Homo sapiens
cgacgagttcgagtttgagaccgtgctggtgcaacatatggagactccgtctctacagaaggtcttgaacatatatacagcgctggtggcacacacctgtagtcccagttactcagtagactgagaaaatgcttggacagaagagatgagtactatttccactaaggcctagaattgcctactgtacaaatagtcctgatcaggcaatatacgaatggcccaaggaagccaccaaattgattttcaggttttacatgacctgcgacaaaaattccctgaagtacctgaagttgttgtatccaggtgcatgttacagaataataataacctggatgcctgctgtgctgttctctctcaggagagtacaagatatctttatggtgaaggagacttgaatttttcagatgattctggaatttctggtctacgcaatcacatgacttctctcaacttggacttgcaatcacagaacatttaccaccatggaagagaaggaagtaggatgaatggaagtaggactctaacgcacagcattagtgaaggccccggagagcacgagacggatgacgaaccagcaccagcgaaggggaggccccggagaccacgagacagatgaggaaccagcaccagctaaggggaggccccgagacactgcgac

SEQ ID NO: 305848 - DNA, 682 bp, Homo sapiens
taataaggaggaggagagacagaggataagatgctagcagagaattagatgaaaagttttaggcagctaggaatgtggagatgtgggtagtggtggctgccaagcacaggaaaatgatcatgctgaactgtacaaaggagattgtctctgaaccttttcataggttctgacactctatatatgtcatcttatttaaaaccctctgtattaaaatgataaggatttggagacattgaaattatatagaatttaaatgtatgcatgttcatatgtttttgcctctggctcatatttccagaatacttaacagtattttaacattttgtttcttatgattctggtcctaaaaaatcaaggacgctgcttactcagaaagctaaaaaacctgagtaagtactcttaggagttatactttttatgttttctttagttaatcactaaacttgactgatcttgataaaactaaggaattagagattgctaagagggtactatctttttctaagtattccatctctcaaaacagcctatttactagtaagtggtacttaacctacattcattcagcctcctaggaaaagaaaaagatgccagaataatgatcccacagctcctacgttgaggttatgcgtttcacttggattttcacttggatttttattgactcattttacagaatatg

SEQ ID NO: 305849 - DNA, 5622 bp, Homo sapiens
  misc_feature (1)..(2): n is a, c, g, or t
  misc_feature (4)..(4): n is a, c, g, or t
  misc_feature (4598)..(4598): n is a, c, g, or t
nngncaaaaatgccagggaaaggcgagcccagagcttggtgatggagaaattgggaagccaccccccacccttcaatcttaggatggggaattcgcaactgaagccggagcttcagacttggggcgcactcccagcttagcccaggaaagagatttaagggcgcagcagtgtggatacctctcaccccggccccgaaggtctagcgagggtctaacctgggccccttgccaggcccgccccccgcccctttccagcccccggcccgtgcgccgctgcccctttaagaagcccaggtaggcaggcccggctgctggagccgctcctatggcaacccgcgagctgcggcggcttcatgaatattccggggcgcgggagcccgagcgctgccggagggcgcttcgggggaggcggccgctgatgtaagcccggcgggtcgctgggctccgctcggttgcggcgggagccccgggacgggccggacgggccggggcagaggaggcgaggcgagctcgcgggtggccagccacaaagcccgggcggcgagacagacggacagccagccctcccgcgggacgcacgcccgggacccgcgcgggccgtgcgctctgcactccggagcggttccctgagcgccgcggccgcagagcctctccggccggcgcccattgttccccgcgggggcggggcgcctggagccgggcggcgcgccgcgcccctgaacgccagagggagggagggaggcaagaagggagcgcggggtccccgcgcccagccgggcccgggaggaggtgtagcgcggcgagcccggggactcggagcgggactaggatcctccccgcggcgcgcagcctgcccaagcatgggcgcctgaggctgcccccacgccggcggcaaaggacgcgtccccacgggcggactgaccggcgggcggacctggagcccgtccgcggcgccgcgctcctgcccccggcccggtccgaccccggcccctggcgccatggacaagctgccgccgtccatgcgcaagcggctctacagcctcccgcagcaggtgggggccaaggcgtggatcatggacgaggaagaggacgccgaggaggagggggccgggggccgccaagaccccagccgcaggagcatccggctgcggccactgccctcgccctccccctcggcggccgcgggtggcacggagtcccggagctcggccctcggggcagcggacagcgaagggccggcccgcggcgcgggcaagtccagcacgaacggcgactgcaggcgcttccgcgggagcctggcctcgctgggcagccggggcggcggcagcggcggcacggggagcggcagcagtcacggacacctgcatgactccgcggaggagcggcggctcatcgccgagggcgacgcgtcccccggcgaggacaggacgcccccaggcctggcggccgagcccgagcgccccggcgcctcggcgcagcccgcagcctcgccgccgccgccccagcagccaccgcagccggcctccgcctcctgcgagcagccctcggtggacaccgctatcaaagtggagggaggcgcggctgccggcgaccagatcctcccggaggccgaggtgcgcctgggccaggccggcttcatgcagcgccagttcggggccatgctccaacccggggtcaacaaattctccctaaggatgttcggcagccagaaagccgtggagcgcgaacaggagagggtcaagtcggccggattttggattatccacccctacagtgacttcagattttactgggacctgaccatgctgctgctgatggtgggaaacctgattatcattcctgtgggcatcaccttcttcaaggatgagaacaccacaccctggattgtcttcaatgtggtgtcagacacattcttcctcatcgacttggtcctcaacttccgcacagggatcgtggtggaggacaacacagagatcatcctggacccgcagcggattaaaatgaagtacctgaaaagctggttcatggtagatttcatttcctccatccccgtggactacatcttcctcattgtggagacacgcatcgactcggaggtctacaagactgcccgggccctgcgcattgtccgcttcacgaagatcctcagcctcttacgcctgttacgcctctcccgcctcattcgatatattcaccagtgggaagagatcttccacatgacctacgacctggccagcgccgtggtgcgcatcgtgaacctcatcggcatgatgctcctgctctgccactgggacggctgcctgcagttcctggtacccatgctacaggacttccctgacgactgctgggtgtccatcaacaacatggtgaacaactcctgggggaagcagtactcctacgcgctcttcaaggccatgagccacatgctgtgcatcggctacgggcggcaggcgcccgtgggcatgtccgacgtctggctcaccatgctcagcatgatcgtgggtgccacctgctacgccatgttcattggccacgccactgccctcatccagtccctggactcctcccggcgccagtaccaggaaaagtacaagcaggtggagcagtacatgtcctttcacaagctcccgcccgacacccggcagcgcatccacgactactacgagcaccgctaccagggcaagatgttcgacgaggagagcatcctgggcgagctaagcgagcccctgcgggaggagatcatcaactttaactgtcggaagctggtggcctccatgccactgtttgccaatgcggaccccaacttcgtgacgtccatgctgaccaagctgcgtttcgaggtcttccagcctggggactacatcatccgggaaggcaccattggcaagaagatgtacttcatccagcatggcgtggtcagcgtgctcaccaagggcaacaaggagaccaagctggccgacggctcctactttggagagatctgcctgctgacccggggccggcgcacagccagcgtgagggccgacacctactgccgcctctactcgctgagcgtggacaacttcaatgaggtgctggaggagtaccccatgatgcgaagggccttcgagaccgtggcgctggaccgcctggaccgcattggcaagaagaactccatcctcctccacaaagtccagcacgacctcaactccggcgtcttcaactaccaggagaatgagatcatccagcagattgtgcagcatgaccgggagatggcccactgcgcgcaccgcgtccaggctgctgcctctgccaccccaacccccacgcccgtcatctggaccccgctgatccaggcaccactgcaggctgccgctgccaccacttctgtggccatagccctcacccaccaccctcgcctgcctgctgccatcttccgccctcccccaggatctgggctgggcaacctcggtgccgggcagacgccaaggcacctgaaacggctgcagtccctgatcccttctgcgctgggctccgcctcgcccgccagcagcccgtcccaggtggacacaccgtcttcatcctccttccacatccaacagctggctggattctctgcccccgctggactgagcccactcctgccctcatccagctcctccccaccccccggggcctgtggctccccctcggctcccacaccatcagctggcgtagccgccaccaccatagccgggtttggccacttccacaaggcgctgggtggctccctgtcctcctccgactctcccctgctcaccccgctgcagccaggcgcccgctccccgcaggctgcccagccatctcccgcgccacccggggcccggggaggcctgggactcccggagcacttcctgccacccccaccctcatccagatccccgtcatctagccccgggcagctgggccagcctcccggggagttgtccctaggtctggccactggcccactgagcacgccagagacacccccacggcagcctgagccgccgtcccttgtggcaggggcctctgggggggcttcccctgtaggctttactccccgaggaggtctcagcccccctggccacagcccaggccccccaagaaccttcccgagtgccccgccccgggcctctggctcccacggatccttgctcctgccacctgcatccagccccccaccaccccaggtcccccagcgccggggcacacccccgctcacccccggccgcctcacccaggacctcaagctcatctccgcgtctcagccagccctgcctcaggacggggcgcagactctccgcagagcctccccgcactcctcaggggagtccatggctgccttcccgctcttccccagggctgggggtggcagcgggggcagtgggagcagcgggggcctcggtccccctgggaggccctatggtgccatccccggccagcacgtcactctgcctcggaagacatcctcaggttctttgccaccccctctgtctttgtttggggcaagagccacctcttctggggggccccctctgactgctggaccccagagggaacctggggccaggcctgagccagtgcgctccaaactgccntccaatctatgagctgggcccttccttccctcttctttcttcttttctctcccttccttcttccttcaggtttaactgtgattaggagatataccaataacagtaataattatttaaaaaaccacacacaccagaaaaacaaaagacagcagaaaataaccaggtattcttagagctatagatttttggtcacttgcttttatagactattttaatactcagcactagagggagggagggggagggaggagggagcaggcaggtcccaaatgcaaaagccagagaaaggcagatggggtctccggggctgggcaggggtgggagtggccagtgttggcggttcttagagcagatgtgtcattgtgttcatttagagaaacagctgccatcagcccgttagctgtaacttggagctccactctgcccccagaaaggggctgccctggggtgtgccctggggagcctcagaagcctgcgaccttgggagaaaagggccagggccctgagggcctagcattttttctactgtaaacgtagcaagatctgtatatgaatatgtatatgtatatgtatgtaagatgtgtatatgtatagctatgtagcgctctgtagagccatgtagatagccactcacatgtgcgcacacgtgtgcggtctagtttaatcccatgttgacaggatgcccaggtcaccttacacccagcaacccgccttggcccgcaggctgtgcactgcatggtctagggacgttctctctccagtcctcagggaagaggaccccaggacttcgcagcaggccccctctctccccatctctggtctcaaagccagtcccagcctgacctctcaccacacggaagtggaagactcccctttcctagggcctcaagcacacaccgccacctctggggccgtcagtttgcccatctgtacagtgggaggtgagcggaacttctgtttattgagtctgctctgtgccaagcactggtttcgcactttacacacattaactccttcagtttca

SEQ ID NO: 305850 - DNA, 2700 bp, Homo sapiens
aaaaaaagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacagaaaaaattggccat

SEQ ID NO: 305851 - DNA, 2492 bp, Homo sapiens
aaaaaaagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacagaaaaaattggccat

SEQ ID NO: 305852 - DNA, 2620 bp, Homo sapiens
  misc_feature (6)..(6): n is a, c, g, or t
tgaaanagacactaggctaggtacgaggcctgggtggtggggggctcaggcggcggcggctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacagaaaaaattggccat

SEQ ID NO: 305853 - DNA, 2609 bp, Homo sapiens
aactaatacggctagacatgctcgtggtgagggctcagcggcggcggactcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacagaaaaaattggccat

SEQ ID NO: 305854 - DNA, 2625 bp, Homo sapiens
aaaaaaagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacagaaaaaattggccat

SEQ ID NO: 305855 - DNA, 2800 bp, Homo sapiens
aaaaaaagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacggtgagacaatgaagacctcctaggaggcaggtgggccggtaagggtgggtgaggggatgggctggaaggccagaagactccatcttggtcttgcccacagatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacagaaaaaattggccat

SEQ ID NO: 305856 - DNA, 2209 bp, Homo sapiens
aaaaaaagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagtgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacagaaaaaattggccat

SEQ ID NO: 305857 - DNA, 1734 bp, Homo sapiens
aaaaaaagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacagaaaaaattggccat

SEQ ID NO: 305858 - DNA, 2297 bp, Homo sapiens
aaaaaaagtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcgagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggcctggccttcaccatggcgggagggagaccgcatctgaagaggagtttctccatcatcccctgctttgtcttcgtggagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacgatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcgatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtcacctgcgttgtgcataactttcagagccggccaccctctggccgaaggctctctccctgggaggacctgggccaagcccccaccatggatagccccctcgaaaagaacccgaggtctgcaggccgcattcgacaccggcacggctcaccccatccaagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgacccctcctcatctttaataaagacctggcttctcatctttaataaagacctgtttgtaacagaaaaaattggccat

SEQ ID NO: 305859 - DNA, 288 bp, Homo sapiens
ggtctcagaaccatggggaagtggagggatcacccatctctgtggacataggtcctgggcggacagccccaaagaatgaaagggagcacccccgtcttcttcccagggggacacggttaatcatgagaactgtggttgtcttttccatggggctcttcacctgatgagctccttgtggctgtggccggtagggcccagggggccactagccccttccgtctgtctctttgtctcaggaacccgaggtctgcaggccgcattcgacaccggcacggctcaccccatcca

SEQ ID NO: 305860 - DNA, 1349 bp, Homo sapiens
gttttataaatggggtagggaccaactgaaagacaggaaaataaggcccttgatgccattaatcttttatcctcttgccctcattggtatcttcatcccaccttgggtcccagtcccctctcctgttcccacaccacctgtcacatgcaagggatgatggctgtctgctcctgggtctatgctttgtggaagaaggatgctgtggagggagcatatccaagctctaaagtggcattctctcccaccctttgcagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagtaagtgagggatcagcccccagagaccctacttctcttccctgctgtctattcggctccctctttgagaagaagaaaagagagcattctgaaactattctgtctagcttgggtagatgagatgagtcagccaagctcagacgtggttcccagacctcacctctaagtaatgtgccctgataggtcccaaagtggccagagaccttggccccttggtcacatcctatttaagggtaaaagaggggtgccctactttcccggtgtctgaacctgggggcgggtgagggttagaaccactgcttccgctgatacccagccttgccctggcaggactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggaggtgagagagttcaaagggggtgaagggcagggtgacaactctgggcaaaaaaagtcaggaatggagacactggagtgaagaactggcctcaaagtggggagggactgttggcaagtgaaatataaattaacaccattagtcaaccagtcttagattctgagggctgggacagagagaaggtgttggagggagttctggtcagttctctaaaaggacaactactataaagggattgtcccagggcaaagataacaggccaggcacggtggctcgcgcctataatcccagcacgttgggaggccaaggcgggcggatcacctgaggtcgggagttcgagaccagcctgaccaacatggagaaaccctgtctctactaaaaatacaaaaaaagtagccgggcgt

SEQ ID NO: 305861 - DNA, 407 bp, Homo sapiens
cggccgcggttgggcaaggagtcctggagaggacgctgcgggcttgggcgatagacaagctcgaagatgtggaaaaactgagtaggtggggatggagggctgcaggggaccctggggttggagagatgaaggacgctggggaatgcggattacattctgcagagcctgatggctaggatggagttagagtctacgggaagccgggggtgggggcgggggcgggggcgtgccgagtattcctccgaggcatgacttagagggaagacgtttctgggccgggagcctgcgaccctgtgcccttcctacactccctcttcccactccctccaacccccctccaccccgcactgcagcacctcccggtgggggcagggaggctgagagggaggttggctacaggaagtgga

SEQ ID NO: 305862 - DNA, 243 bp, Homo sapiens
  misc_feature (3)..(3): n is a, c, g, or t
  misc_feature (20)..(20): n is a, c, g, or t
  misc_feature (22)..(22): n is a, c, g, or t
  misc_feature (36)..(36): n is a, c, g, or t
  misc_feature (49)..(49): n is a, c, g, or t
  misc_feature (62)..(62): n is a, c, g, or t
  misc_feature (93)..(93): n is a, c, g, or t
  misc_feature (95)..(95): n is a, c, g, or t
ccnctcctcacacacacacncnctcacacacacacncacagggacacgncgcctaggggccncccccctatgccactccagacacaccatacncncccatcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305863 - DNA, 2307 bp, Homo sapiens
tgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305864 - DNA, 1942 bp, Homo sapiens
tgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305865 - DNA, 2134 bp, Homo sapiens
ggggtgggatctaggggggcccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305866 - DNA, 2125 bp, Homo sapiens
cggccgcggttgggcaaggagtcctggagaggacgctgcgggcttgggcgatagacaagctcgaagatgtggaaaaactgattctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305867 - DNA, 2112 bp, Homo sapiens
gtgtggggagcgggcgtcggaaggacccgtgaggataggaaaatggggccatttgagccctggcaaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305868 - DNA, 2628 bp, Homo sapiens
gttttataaatggggtagggaccaactgaaagacaggaaaataaggcccttgatgccattaatcttttatcctcttgccctcattggtatcttcatcccaccttgggtcccagtcccctctcctgttcccacaccacctgtcacatgcaagggatgatggctgtctgctcctgggtctatgctttgtggaagaaggatgctgtggagggagcatatccaagctctaaagtggcattctctcccaccctttgcagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagtaagtgagggatcagcccccagagaccctacttctcttccctgctgtctattcggctccctctttgagaagaagaaaagagagcattctgaaactattctgtctagcttgggtagatgagatgagtcagccaagctcagacgtggttcccagacctcacctctaagtaatgtgccctgataggtcccaaagtggccagagaccttggccccttggtcacatcctatttaagggtaaaagaggggtgccctactttcccggtgtctgaacctgggggcgggtgagggttagaaccactgcttccgctgatacccagccttgccctggcaggactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305869 - DNA, 2307 bp, Homo sapiens; identical to SEQ ID NO: 305863

SEQ ID NO: 305870 - DNA, 1751 bp, Homo sapiens
cgaacaaaaaaaaataggctagtaagagctggtgtaaatcggccgaggaacttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305871 - DNA, 1942 bp, Homo sapiens; identical to SEQ ID NO: 305864

SEQ ID NO: 305872 - DNA, 1493 bp, Homo sapiens
gctcgcaccccctatgcgcctgtcctcatccgctaccccaacagtcgacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305873 - DNA, 2174 bp, Homo sapiens
tgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305874 - DNA, 2202 bp, Homo sapiens
aaggagctggaacaaagagcagagcagaacccaggcttccctccaggctgacatgttcctagtggccgtatcagtcactcacagtttggagtcctcagtggatgttctcacagctgttgttagatggccatcccctgagatccactgaagattcattttttaatcaggcatccagtgcattgaagagcaatgttatcatcatgaggaggaacaagggagaaataatcagtaaggactataaatttctgaaaccactttagagagtggcgaaggtggggaatcataagaccttttggggtgctgggtgagggtctttgaaggagagtcatgaaggttacgtgggaagatgacatgtagaagaaacaacaccggacagttagatggttgagagcttgagacccagctatatctgtaggacttgggcagattattttaaatatcctatagcttctctagaggaattttctcaagattcttagcaagccatgtatttctcaagatttaaccaagttccctggtcaacttccaaaaatcctaaaagattcttaatgcttatgaacaaccaacagtggtcccaaggagctttttgatctgagatgcagaatgtgaccctcaacatcctctgaagggacagagtgaccaggtatctagattccttagattgaggcggactgtccccgaaaagagcttcccccacttggcctgtagcagagcagaaacaaaaattcaaatgccatggtctcccatggagctggtacagcaggcatcctccttgtgtttttcataagaaattatgcctgtgtccccctttcaatctgttggaccagttcttctacataggctgagtcagagagaaccagtttgtctagcctggggaccaggactgccctccgctggcatgtcagagacttcatagtagcttcagcattcctgagggattcccttacattcctaggagatccctttatgggagggctttgtcaccaggtgacctgatatagcttgagaaagcctatgacctgagagaaattccagggatcctaaagagtttggagctcacagttctgaggggagcagtcacagggatcacccccattatttgctgagaagagggaggagtcaaaatccaaagagcaggaagggaggcgcagggtccccgcattgccctggtttctttttcacaccaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305875 - DNA, 1673 bp, Homo sapiens
ggctcccggcccgccagcaccagtatcgggggtcgcacggcggctgtcccctgagccttctctcagtatgcagaatgtgaccctcaacatcctctgaagggacagagtgaccaggtatctagattccttagattgaggcggactgtccccgaaaagagcttcccccacttggcctgtagcagagcagaaacaaaaattcaaatgccatggtctcccatggagctggtacagcaggcatcctccttgtgtttttcataagaaattatgcctgtgtccccctttcaatctgttggaccagttcttctacataggctgagtcagagagaaccagtttgtctagcctggggaccaggactgccctccgctggcatgtcagagacttcatagtagcttcagcattcctgagggattcccttacattcctaggagatccctttatgggagggctttgtcaccaggtgacctgatatagcttgagaaagcctatgacctgagagaaattccagggatcctaaagagtttggagctcacagttctgaggggagcagtcacagggatcacccccattatttgctgagaagagggaggagtcaaaatccaaagagcaggaagggaggcgcagggtccccgcattgccctggtttctttttcacaccaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305876 - DNA, 2233 bp, Homo sapiens
tgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtccagtcatattgatgttaccattacttgggaaggaaagggatgaatggttgtaggacgcccgttggaaaatcacaaatgtttccaaggttcgtcctcttggccatagctggatgaatcttcctcttcggacagggctctttcctgcacagaaatcatactgaggttccatatcctccctcctgctgtcatctcctatatgtacattttaacagacttcctcgtgaacctcttttcagcccattccctcttgctctgtcctcattaaagattaaaaaatagcttgctaccattcc

SEQ ID NO: 305877 - DNA, 1412 bp, Homo sapiens
tgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttaccgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305878 - DNA, 1226 bp, Homo sapiens
tgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtctctggctcacagctctcagccctgcagccatgtggatgtggaattcctcctgtggtataaaccagccctgaagagaagaagcaccaacctctatggcaacatgttcaaaggtccatggcacaggcctggcatcagcacgaaggagtgaggagaaaccggaatgatgggccgtgaaggggcgacacacactgaaggcaagccgaacggcgccacaaagaacgggcacagcgaaaaaaccgaatgagaacactagcacaggggtcgaacaacaagcggaaaggcaaaagaagaaaaacgaaaaagaaaacaaaatgggttccc

SEQ ID NO: 305879 - DNA, 499 bp, Homo sapiens
  misc_feature (161)..(161): n is a, c, g, or t
  misc_feature (163)..(163): n is a, c, g, or t
  misc_feature (167)..(167): n is a, c, g, or t
tcctgcacacgccgcgatccacaccaagagacaattgtgggcagagaggagccagtccatggggccgcacagcacagattaagagattcagaaattatgtgtgtatgtttgtgtgtgttatatgtgtgtgggtgctcggcgtgtgcatgcacacgccgaangnccancgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305880 - DNA, 449 bp, Homo sapiens
  misc_feature (111)..(111): n is a, c, g, or t
  misc_feature (113)..(113): n is a, c, g, or t
  misc_feature (117)..(117): n is a, c, g, or t
cgtgaagatcggcgacatggtctctcggcgtgtgcagtgtggagcttcggcgtgtgcgtgaagatcgcgattacggtctggagattcggcgtgtgcatgcacacgccgaangnccancgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtcca

SEQ ID NO: 305881 - DNA, 1042 bp, Homo sapiens
tgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtgtgagttctggtattcctgggggtgagggtggggagcagggtccatcagagaattcctggcccatcttccaatctcccgacaaggtgaatggcccttcttcatctgaggactgagagaactctagaggagacaccactttccccctg

SEQ ID NO: 305882 - DNA, 680 bp, Homo sapiens
tgcgccgcctgctccccgcccctcggccgcctgcaccgggcggggcccgggccagagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggctgactgggcttgctccggattcgcgttcgtggccagcgagcctctcgcgagtac

SEQ ID NO: 305883 - DNA, 904 bp, Homo sapiens
gttttataaatggggtagggaccaactgaaagacaggaaaataaggcccttgatgccattaatcttttatcctcttgccctcattggtatcttcatcccaccttgggtcccagtcccctctcctgttcccacaccacctgtcacatgcaagggatgatggctgtctgctcctgggtctatgctttgtggaagaaggatgctgtggagggagcatatccaagctctaaagtggcattctctcccaccctttgcagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagtaagtgagggatcagcccccagagaccctacttctcttccctgctgtctattcggctccctctttgagaagaagaaaagagagcattctgaaactattctgtctagcttgggtagatgagatgagtcagccaagctcagacgtggttcccagacctcacctctaagtaatgtgccctgataggtcccaaagtggccagagaccttggccccttggtcacatcctatttaagggtaaaagaggggtgccctactttcccggtgtctgaacctgggggcgggtgagggttagaaccactgcttccgctgatacccagccttgccctggcaggactgtgtgccacaacggggtgctaggcctgagccgcctgctgtttttcctgctgggcttcctccggattcgcgttcgtggccagcgagcctctcgccttcaagcccctgtccttgttgctgatcctccatccatcactatccagtatttatcacgttatggggtacggagattgct

SEQ ID NO: 305884 - DNA, 603 bp, Homo sapiens
ggctctgggcattccagccaccgaatgtgagtttgtagggagcttacctgtgattgtggtgggccggctgaaggtggcgttggaaccacagctctgggaactgggaaaagtgcttcggaaggctgggtaagtggtcttggaaatgagggtatgagcagtgtcacagagagagagagagagagaataagaaggggagaaatgagaaggaagaaggaaaatcttaaaaatgaaaaaaactgggaagaaagataatagaataaataaaaggaagtggggaataaatggaaggatatgtaataatgcaggtgaaaaaagtaagaaggggccgggcacggtggctcacacctgtaatcccagcactttgggaggccaaggcgggtggatcacctgaggtcaggagttcaagaccagcctgaccaacatggcaaaaccccatctctgctaaaaatacaaaatttgccgggtttggtggcacatgcctgtaatcccagctacttgggaggctgaggcaggagaattgcttgaacctgggaggtggaggttgcagtgagccaaggtcgtgccactgcactccagcctgggtgacagagcaagactccgtca

SEQ ID NO: 305885 - DNA, 281 bp, Homo sapiens
tcctcatccgctaccccaacagtctggtgagtcttagtccaagaaagagtggaaagggggagcacaaatccaccccaaatggaaataagtgaaaactgttggtgctttaatgggatgtgcattgggggctgtgaccagaggtgggatcaggccctctgttcaaaggtgattggccagttccagggggaaaaagtaatgctcttatgccctcacctgtgtttctcccataggacaccaccagctgggcatggaggggtcctggagtgtgagttctggtattc

SEQ ID NO: 305886 - DNA, 2773 bp, Homo sapiens
tcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagggggaggttgtacccactggctctgagcagaccacagagtctgaaactccagtccctgcagcagcagaaactgcggatcccttgttttaccctagttggtataaaggccaaacccggaaagccaccaccaacccaccttgcaccccagggagcgaaggtctggggcaaatagggcctccaggttctgaggattcgaatgtacggaaggcagaagtggcagcagccgcagcgagtgagagggcagctgtgagtggtaaggaaactagtgcacctgcagctacttctcagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaatcttctattgtgtggaaaatgttgtgaagggtgtgtaggtgtggtacatgtgtatgtcactaacaagtggcaaatggtgaaaaaagtggtcactatgcttttgtctctcataggcactgactttttgttattatattatggtagctttcatttcctttactctttaacagtgcaggtggtcagtgaaaatcagtgtcaactcagaagtgactgatttatcaatacatggacaaaaagtaaatcattgaccaaagctatgaaatgtttcacaaagttttcctcttttgcataacagatgtcactggatgtacattcagaaatgttctttgaatttggtgacactttcatggtccagaaagctgaaggcctgggcatctcttgtgacatttttctaatattagttttagattttcacgtattaggcactttagttgaatcttccagcaaaagctgtctactttctcttttattcactgtggcaccaatctggtaaattgtagaacaattgcatgtgtttaaatatatatacaaacatatcacacattaaatatatatatatttaaatcatgctttgttaatatttgtcccaccataatgcctccttcagaacataagtgtaactttatatgaactcttaaataaatgatgtttttaaaaaaaaaaaa

SEQ ID NO: 305887 - DNA, 1820 bp, Homo sapiens
tcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaa

SEQ ID NO: 305888 - DNA, 2108 bp, Homo sapiens
tcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatctttttccaaagagcagcagaccatggataacttagagaagcaactcatctgtcccatctgcttagagatgttcacgaaacctgtggtgattctcccttgtcagcacaacctgtgtaggaaatgtgccagtgatattttccaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagggggaggttgtacccactggctctgagcagaccacagagtctgaaactccagtccctgcagcagcagaaactgcggatcccttgttttaccctagttggtataaaggccaaacccggaaagccaccaccaacccaccttgcaccccagggagcgaaggtctggggcaaatagggcctccaggttctgaggattcgaatgtacggaaggcagaagtggcagcagccgcagcgagtgagagggcagctgtgagtggtaaggaaactagtgcacctgcagctacttctcagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaa

SEQ ID NO: 305889 - DNA, 1109 bp, Homo sapiens
gtgaacactcacatataggtctttgtgtgaatacatgttttcatctctcttgagtaaatgaaggagtggaattgctggattgtatgattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaatcttctattgtgtggaaaatgttgtgaagggtgtgtaggtgtggtacatgtgtatgtcactaacaagtggcaaatggtgaaaaaagtggtcactatgcttttgtctctcataggcactgactttttgttattatattatggtagctttcatttcctttactctttaacagtgcaggtggtcagtgaaaatcagtgtcaactcagaagtgactgatttatcaatacatggacaaaaagtaaatcattgaccaaagctatgaaatgtttcacaaagttttcctcttttgcataacagatgtcactggatgtacattcagaaatgttctttgaatttggtgacactttcatggtccagaaagctgaaggcctgggcatctcttgtgacatttttctaatattagttttagattttcacgtattaggcactttagttgaatcttccagcaaaagctgtctactttctcttttattcactgtggcaccaatctggtaaattgtagaacaattgcatgtgtttaaatatatatacaaacatatcacacattaaatatatatatatttaaatcatgctttgttaatatttgtcccaccataatgcctccttcagaacataagtgtaactttatatgaactcttaaataaatgatgtttttaaaaaaaaaaaa

SEQ ID NO: 305890 - DNA, 444 bp, Homo sapiens
gtgaacactcacatataggtctttgtgtgaatacatgttttcatctctcttgagtaaatgaaggagtggaattgctggattgtatgattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaa

SEQ ID NO: 305891 - DNA, 987 bp, Homo sapiens
aacaaacaaaaaaactttataaagttgcatttactttcaagaaaaacacgtttcttttaatgatttggtttgtgtcctctttactcccaaatctagttttattttaatactaagaatcatattttttttttaagtcaaaccatttaatgtgtttcaaaactataaatgagtaactgctgaagacatgagtgtggagtttctggctggaactttgggttctgaaagtggtggacggaaaagcaccttacgtggacaatggtatattcgcagatgactgtggataaggtctgaccctgtgtttcaggaccacttgctgagaaagccctgagggatgatcttatggcaagcttaaagtagaagttcatgttgtttgtagtagcagagagtgaaaataagtctcagagaagctgcttgtggcattacccaattccttttttcttacttggcaagaacaggcctctaacccgtatttgcccacaagaggaggtaccaccatggcatcagggggccgattccgctgcccatcctgtagacatgaagtggttttggatagacatggggtatatggacttcagaggaacctgctggtggaaaatatcattgacatctacaagcaggagtccaccaggtaacactcttccactcttccatgtgtcaagcccatctgaaacttgtttttgtttgtttgttttaatgggttgctacgctgaatgcttgtttatcaatcacagactgttttatggaaaaatggttttccaagtcagtccttcccagtgagactgagagttgctcacagcaggagagaggggagttggtgcccatgcttttgtatcaatttaagaatgaagtgactcattaacaccaatccattccagatggtgatgctgaaagagacatactgctgtccccctccaccttaaagcctggtattacatccattttacacattttgcacttcacaggcactttgtagctccagatccctac

SEQ ID NO: 305892 - DNA, 1802 bp, Homo sapiens
ctcctcggattacgcatgctcagtgcaatcttcggttgcctggactagcgctccggtttttctgtgctgaacctcaggggacgccgacacacgtacacgtcccttcgatagctcagctggtagagcggaggactgtagctacttcctcagcaggagacatccttaggtcgctggttcgattccggctcgaaggagacaagtgcggtttttttctccagctcccgatgacttatggcactttccttgggtgccttcagtgacacattgcattccaacgagcagtttgaaagtctagcgctttctccccattttgggcctcccagcctgcacgggactcatctgaggctaagctgcccatagttcggggagacccacagggaaaacaaaacaagaaacagagaacttggaaacggacgctgattactttgaacgtttgctcaaccgaggaagcaggaactgttcggccccatctcaagtccgcagggcggactgcctggctctgggcagatccgaggtggataggacaaggcaaaaggtagccctggagaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggaatgttgcagaaaacagaaacaagagctttgtgagaagtttgattacctgtatggcattttggaggagaggaagaatgaaatgacccaagtcattacccgaacccaagaggagaaactggaacatgtccgtgctctgatcaaaaagtattctgatcatttggagaacgtctcaaagttggttgagtcaggaattcagtttatggatgagccagaaatggcagtgtttctgcagaatgccaaaaccctgctaaaaaaaatctcggaagcatcaaaggcatttcagatggagaaaatagaacatggctatgagaacatgaaccacttcacagtcaacctcaatagagaagaaaagataatacgtgaaattgacttttacagagaagatgaagatgaagaagaagaagaaggcggagaaggagaaaaagaaggagaaggagaagtgggaggagaagcagtagaagtggaagaggtagaaaatgttcaaacagagtttccaggagaagatgaaaacccagaaaaagcttcagagctctctcaggtggagctgcaggctgcccctggggcacttccagtttcctctccagagccacctccagccctgccacctgctgcggatgcccctgtgacacagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaa

SEQ ID NO: 305893 - DNA, 409 bp, Homo sapiens
aaattaaccgtgtcgttctccccctccattttttacacctccccccatcacattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttatacaaa

SEQ ID NO: 305894 - DNA, 1383 bp, Homo sapiens
ctcctcggattacgcatgctcagtgcaatcttcggttgcctggactagcgctccggtttttctgtgctgaacctcaggggacgccgacacacgtacacgtcccttcgatagctcagctggtagagcggaggactgtagctacttcctcagcaggagacatccttaggtcgctggttcgattccggctcgaaggagacaagtgcggtttttttctccagctcccgatgacttatggcactttccttgggtgccttcagtgacacattgcattccaacgagcagtttgaaagtctagcgctttctccccattttgggcctcccagcctgcacgggactcatctgaggctaagctgcccatagttcggggagacccacagggaaaacaaaacaagaaacagagaacttggaaacggacgctgattactttgaacgtttgctcaaccgaggaagcaggaactgttcggccccatctcaagtccgcagggcggactgcctggctctgggcagatccgaggtggataggacaaggcaaaaggtagccctggagaggccagaaaagaaatccgaccagcccatgtgcgaggaacatgaagaggagcgcatcaacatctactgtctgaactgcgaagtacccacctgctctctgtgcaaggtgtttggtgcacacaaagactgccaggtggctcccctcactcatgtgttccagagacagaagtctgagctcagtgatggcatcgccatcctcgtgggcagcaacgatcgagtccagggagtgatcagccagctggaagacacctgcaaaactatcgaggtgagtcaggtgactcccacagcgtctcaaccaagcctgcaatgcctgggggtttatgacttccttagtgccacactagacatccctattctgacctttcattctttgcttctagaatggcctccttcctgatatgtctctgaaatattcacctcctgcacagaaagagacattatcacatgagtcactgaggcagatgttaccacaattactagggctgttgctgtatgtgttgttctttcttccttttgaaagattagctacaagaaaattaaatcccccatcatggaaatcagtgttgttgctattacagcaaactttcctggtggaaatccaaactgtcttaggaaatgctcatcggtgctttagacagtcataggcaggtttgagctgcacttctctgctcttacagcagtgctgcgaagtggccataaggaggagaaagatctgcctagctgtagttagagaatggctcagtggctgggagctcatggaggccaagagtttgagctcattcatctccacttgccctctgcctggcccaatgcctggcacataatcaaccctgaaaa

SEQ ID NO: 305895 - DNA, 418 bp, Homo sapiens
tgactggaccaatccaaaaagaacaaacctcttttttctctgattcccattttcttccattgcagattggatttgaggctcctcccctccagggacaggctgcagctccagcgagtggcagtggagctgattctgagccagctcgccatatcttctccttttcctggttgaactccctaaatgaatgatattcattccaactgctgcccctctgtctgcctggctgagatgcatgtgggcagcaggaagcccaagtgaaattaatattatgcagatgatgaaagggacctctgaacaggatttctgcaaaaatagccccaaactgcaattccatatgacttatctaacatcttggggggaaagaatattttgagaaaatagttgcagaaagcactggaaataataaacttgatcttat

SEQ ID NO: 305896 - DNA, 1873 bp, Homo sapiens
ccaccgtttgtttaattgctcgctcattgaaggatatctgggatgttttcagattttggctattacaaataaagcagctgtgaacaatcacatacaggttttggtgtaaacatgagttttcgtttccctgggataaatgtgtaatttctgagttcagtgtaaattccaagagtgaagtttttgggctgttacgataagtgcatatttagttctgtaggaaactgttagactcattttgcaaagtggccataccattttgcattcctgctagaaatgtatgactgatccagttcctccacactctcgacagcacttggtgttttcatctcttgtgattgttgagttgtgtagtaacatctcttgtggttttagtttgcatttctctaattagacattttttatgtgcttgtttgccatccgtatatcctcttcagtgaaatatccattcatgtcttttgcccattttctacctagattgtttttcactgttgaattttgagagctttttatgtattccagatacaagtccttcgtcaaatatgtggcttgcagagattatctcccagtctgtattttgttttgttcaacctcttaacaaggtctttgaaaagcaaaaatttctaatttttatggtttattaattttttcttttatgaattgtgcttttggtgtcaagtctaaaaattctttacttatccctagatatcccaaagattttctactatttttcctggaagttttatattatgttttacatttaagtctgtgattagtttatttgaaggctttcctgttttctaatgtaagaattaagtgctataaatttctctctcagcacttctttaaggctatgcctcacatattttgatatgctgtattttcattttcattcagtcctatgtatttttttcttttgagacttcttcttttacccatacattactgagaagtatgttattgaatttccagtagtttagatattttacttttttttttttccttttgagagagggtcttactctgtcacccaggctggagtgcagtgatacgatctcagctcactgcaacctccacctcccgggttcaagtgattctctgacctctgcctcccgagtagctgcgattacaggcgcatgccaccgtgtccggctaacttgtattttttggtagagatgaggtttcactgtgttgcccaggctggtcttgaactcctgacctcaagcgatctgtgcacctcagcctcccaaagtgctgggattacagacatgagccactgtgtcctgccaagattttactattatcttagtgttactgatttctggtttgattccattatgctcagagaaatactctatgatttcagttctcttctgtttcttgaagtttgttttatgatgtaggatgtagtttgtcttagtcagtgtttcattggtgcttagaaaaaatattctgctgttgggtggcatgttctctgggtgttaattagaccagtgggcacagcttttcttcctgaggagccgggctgggagagcctattcccactgggctctgtgagaccagggtgggaggaggattgtgattttgcccttggcgcctggctggagtagaatgaatattactgcaagtgttttctgatgttaggccatccttctcttggtactttggctagcggagttgggcttttctcggctttttctggggtcgggtggtgggctgctctggtcctgttggctgttccaggttggaggcttctgcagcacattgtcagggatctatgggggaagtaaggaagcttggaagccaccacccgtttctcatgtcttgagggccccaggcagcccacctccttttccctcctataacatgtaatata

SEQ ID NO: 305897 - DNA, 395 bp, Homo sapiens
tgctattattattattttgagacagagtcttaactctgttgcccaggcaggagtgcagtggcgagatctggactcactgcaacctctgcctcctggcttcaagcaattctcatgcttcagcctgtagctggaactacaggtcactccctctggaggaaaccagctgccactttgtgaggatactcatagtcctgtggaggcatatcctccatatggctgagacctcctgcgaacaaccatcactgacttgccagacatgagtgtgccaccttggaagcagattttccagccccagttaagccttcagatgacatcagcccctgctaatctcttgactacaacctcatgagagaccctgagccagaactagccaggtaagccactcctgaattcct

SEQ ID NO: 305898 - DNA, 1510 bp, Homo sapiens
tgctattattattattttgagacagagtcttaactctgttgcccaggcaggagtgcagtggcgagatctggactcactgcaacctctgcctcctggcttcaagcaattctcatgcttcagcctgtagctggaactacaggtcactccctctggaggaaaccagctgccactttgtgaggatactcatagtcctgtggaggcatatcctccatatggctgagacctcctgcgaacaaccatcactgacttgccagacatgagtgtgccaccttggaagcagattttccagccccagttaagccttcagatgacatcagcccctgctaatctcttgactacaacctcatgagagaccctgagccagaactagccaggcttacccctcatggttacaaagtggctgcaacagctccaggtgttctatcctttaacacagaataactcaaacaacaagacccaatattcagacaagaaggaaagggacttttggagagtgaagaaaactttcctagaaacctcaaacttctccccatgccttattggccagattgtatcccatgcccatttctaaaccaatcattggcaaagtgagtggaattgacgtgattagattaactttaccaagaatgcatcctcagagaggctgagaaaaagtccagcctcctttgaagagcctggctacctttcacctgaacaaaacaagaattctgatgaaaaatggagaatgtatgtggagcaggcacccggagtgtctatgccaggattttttttcagtgcgtttcaccggttatatttttgtctctttaccttacaagatatgtggcacgtttgcctaaaacaagccttgctttctgatttctgtgcactaggcacttaaaccttgcaaatgtcgcttacctaacagtcactgtcaaggagtacctggctaaagaatctccagctagacaaagtagaagtgtctgtgctctggcagttgaatatattgtatcaggctcaacagcacctttcaccaaaggatgagacttcacaaccattagatcttcttttattttgtttttattaaaaaaaaaaattttaacacaccattgctaacttgaagccattagatcttcttacccccaataccacaaaagtttagtggaatcaggggtataccaaggcaggtggagtaggggagctgggagtggtcagcccccagggcaggcaatgagggattgtgaatctgtgaagaattttaaagcaatgatacagctctaaatgcaatgtactatcctggacttagccctggaaaagaaaaaagatattagtggaaaaactggtaaaattcaaataatgtctgtagtttggttaatagtattataccaatgttaatttctgtgttttgataaatgtaccatggttatgtaagctggatgaaagatatgtgggaaatctctctactatttctgcaactctcctgtaaacctaaaaatgtttcaaaataaaagatttaatgctaaaattgactgaa

SEQ ID NO: 305899 - DNA, 1882 bp, Homo sapiens
gggttgcgggctgtggccccgggggctgagggcggcgcgggtgcggcggaagcagggaagccgcgaaccggccttctggctggccacagcgccctgcacggacgatcagtgaatggagattactcaagtatttatcgagaacttgcagtgggctaggcacagttcaggtccacagttatttcacttctaaataaatatggttttttaaaagtggcacgcggtggaatgtaattgagacaggatggagttcctagagaaattttacttcctcaatctgcactccaccttacttaaaatacagtcttgggtctgtaattcccttatctgactctcaaggaaatgacaaagtaatgcctagattggactaaacctcatttaacttcaaggctgacctttctcaaagttgaaccttcgtcttgtgaggaacagaaagatcaagaactctgaagcacctcgactttccacctgtgaagatgtgttcaaatttgcaacgtgcggccacacctatgaggtcactccctctggaggaaaccagctgccactttgtgaggatactcatagtcctgtggaggcatatcctccatatggctgagacctcctgcgaacaaccatcactgacttgccagacatgagtgtgccaccttggaagcagattttccagccccagttaagccttcagatgacatcagcccctgctaatctcttgactacaacctcatgagagaccctgagccagaactagccaggcttacccctcatggttacaaagtggctgcaacagctccaggtgttctatcctttaacacagaataactcaaacaacaagacccaatattcagacaagaaggaaagggacttttggagagtgaagaaaactttcctagaaacctcaaacttctccccatgccttattggccagattgtatcccatgcccatttctaaaccaatcattggcaaagtgagtggaattgacgtgattagattaactttaccaagaatgcatcctcagagaggctgagaaaaagtccagcctcctttgaagagcctggctacctttcacctgaacaaaacaagaattctgatgaaaaatggagaatgtatgtggagcaggcacccggagtgtctatgccaggattttttttcagtgcgtttcaccggttatatttttgtctctttaccttacaagatatgtggcacgtttgcctaaaacaagccttgctttctgatttctgtgcactaggcacttaaaccttgcaaatgtcgcttacctaacagtcactgtcaaggagtacctggctaaagaatctccagctagacaaagtagaagtgtctgtgctctggcagttgaatatattgtatcaggctcaacagcacctttcaccaaaggatgagacttcacaaccattagatcttcttttattttgtttttattaaaaaaaaaaattttaacacaccattgctaacttgaagccattagatcttcttacccccaataccacaaaagtttagtggaatcaggggtataccaaggcaggtggagtaggggagctgggagtggtcagcccccagggcaggcaatgagggattgtgaatctgtgaagaattttaaagcaatgatacagctctaaatgcaatgtactatcctggacttagccctggaaaagaaaaaagatattagtggaaaaactggtaaaattcaaataatgtctgtagtttggttaatagtattataccaatgttaatttctgtgttttgataaatgtaccatggttatgtaagctggatgaaagatatgtgggaaatctctctactatttctgcaactctcctgtaaacctaaaaatgtttcaaaataaaagatttaatgctaaaattgactgaa

SEQ ID NO: 305900 - DNA, 1946 bp, Homo sapiens
gtggaagaataaacacagaagaagcaaaaaaggaaggaactttctcactgaaagtttctatttaatattaagtcttaaaagtactcctggaaggacaaaaggtgttcttaataaattatattcgcaaatattggatttaatcctaccagtaatgaagcagtcagttactttctagatgtgcagaaatacgtaatgaacaaaaaaactaattcctattccattttttattaggtccacagttatttcacttctaaataaatatggttttttaaaagtggcacgcggtggaatgtaattgagacaggatggagttcctagagaaattttacttcctcaatctgcactccaccttacttaaaatacagtcttgggtctgtaattcccttatctgactctcaaggaaatgacaaagtaatgcctagattggactaaacctcatttaacttcaaggctgacctttctcaaagttgaaccttcgtcttgtgaggaacagaaagatcaagaactctgaagcacctcgactttccacctgtgaagatgtgttcaaatttgcaacgtgcggccacacctatgaggtcactccctctggaggaaaccagctgccactttgtgaggatactcatagtcctgtggaggcatatcctccatatggctgagacctcctgcgaacaaccatcactgacttgccagacatgagtgtgccaccttggaagcagattttccagccccagttaagccttcagatgacatcagcccctgctaatctcttgactacaacctcatgagagaccctgagccagaactagccaggcttacccctcatggttacaaagtggctgcaacagctccaggtgttctatcctttaacacagaataactcaaacaacaagacccaatattcagacaagaaggaaagggacttttggagagtgaagaaaactttcctagaaacctcaaacttctccccatgccttattggccagattgtatcccatgcccatttctaaaccaatcattggcaaagtgagtggaattgacgtgattagattaactttaccaagaatgcatcctcagagaggctgagaaaaagtccagcctcctttgaagagcctggctacctttcacctgaacaaaacaagaattctgatgaaaaatggagaatgtatgtggagcaggcacccggagtgtctatgccaggattttttttcagtgcgtttcaccggttatatttttgtctctttaccttacaagatatgtggcacgtttgcctaaaacaagccttgctttctgatttctgtgcactaggcacttaaaccttgcaaatgtcgcttacctaacagtcactgtcaaggagtacctggctaaagaatctccagctagacaaagtagaagtgtctgtgctctggcagttgaatatattgtatcaggctcaacagcacctttcaccaaaggatgagacttcacaaccattagatcttcttttattttgtttttattaaaaaaaaaaattttaacacaccattgctaacttgaagccattagatcttcttacccccaataccacaaaagtttagtggaatcaggggtataccaaggcaggtggagtaggggagctgggagtggtcagcccccagggcaggcaatgagggattgtgaatctgtgaagaattttaaagcaatgatacagctctaaatgcaatgtactatcctggacttagccctggaaaagaaaaaagatattagtggaaaaactggtaaaattcaaataatgtctgtagtttggttaatagtattataccaatgttaatttctgtgttttgataaatgtaccatggttatgtaagctggatgaaagatatgtgggaaatctctctactatttctgcaactctcctgtaaacctaaaaatgtttcaaaataaaagatttaatgctaaaattgactgaa

SEQ ID NO: 305901 - DNA, 323 bp, Homo sapiens
cccacagcactatatgcttcccttaaaattggcccattgccagtggcaaatcactatctactgtgatccttatcatagacattggtcatatttttacgttattagttttctgtgtatattttagtgctatagcctgccattccaagttaaacatgctcttagcatatcattttacaccgttgatctataattcattacctgagcacatgagcagaggcagggaattatacagtggtaaactacttggtgaaaccatgctttgtatttttaagatgtataattatatttaaaaacaagcaatgcttaattttgtgcctgatttt

SEQ ID NO: 305902 - DNA, 1065 bp, Homo sapiens
aaaaagaagcgatgctttctgtttcctagatataaatttacttcaacaccttttacactgaaagatattctcctaggagacagagaaatttcagctggtatttcatcttatcaattactgaattatgaagatgaatcagatgtttcactctatggaaggcgaggtaaccatattgtaaatgacgttgggattaacgttgctggatcagattccattgcagtgaaagcttcatttggtatagtaaccaaacatgaagtggaagtatcaacattactcaaagaaattactacacgaaaaattaactttgaccacagcttgatacgtcagtcaaggagcagcagaaaggcagtattgtgtgtggtcatggagagcatccgaaccacacgacagtgctcactgtctgtgcatgctggaattcgaggggaagcaatgcggtttcactttatggatgaacagaatcccaagggaagggacaaagctattgttttcccagcacatacaaccatagctttcagtgtttttgaactcttcatatacctggatggtgcctttgacctttgtgtcacttcagtgtcaaaaggaggatttgaaagggaagaaacggcaacatttgcactgctgtacaggttgagaaatatcctatttgaaagaaatagaagagtgatggatgtcatttctcgttcacagctttacttggatgatcttttttctgactactatgacaaacctctcagcatgactgatatttcactcaaagaagggacccatatccgagttaacttacttaatcacaacattcccaaagggccttgcatactctgtggaatggggaacttcaaaagggagacagtttatgggtgctttcagtgttctgttgatggtcagaagtatgtgagacttcatgcagttccttgttttgatatttggcacaagaggatgaaataaaatgaaaaatgaatacaccgtgttggtgttttaggtgcagttgtgccacaaaccttccctaaattatctaggtttgctttgatgaattaaattaaaatgagaaaagcaaaaagaaataaa

SEQ ID NO: 305903 - DNA, 937 bp, Homo sapiens
agatttcctgttaaaaaaaaaaaaaaggcttctgctccagagcattatggttgtggtagcactaatcatgggctgtaataccaaagtaagtgaaaagtgcagaggtatttcctaatatagaccaggagtttctgttggaccaattggatctctgctataaaaaatggtttaattcaagcagaataatcctttacttgggaattttttgttttgtttttggtaggattataggaaatgtttcatttctccaaaaagctatccttacatgttatgatccttaattatgttatttatttattcaatatagtttcactttatggatgaacagaatcccaagggaagggacaaagctattgttttcccagcacatacaaccatagctttcagtgtttttgaactcttcatatacctggatggtgcctttgacctttgtgtcacttcagtgtcaaaaggaggatttgaaagggaagaaacggcaacatttgcactgctgtacaggttgagaaatatcctatttgaaagaaatagaagagtgatggatgtcatttctcgttcacagctttacttggatgatcttttttctgactactatgacaaacctctcagcatgactgatatttcactcaaagaagggacccatatccgagttaacttacttaatcacaacattcccaaagggccttgcatactctgtggaatggggaacttcaaaagggagacagtttatgggtgctttcagtgttctgttgatggtcagaagtatgtgagacttcatgcagttccttgttttgatatttggcacaagaggatgaaataaaatgaaaaatgaatacaccgtgttggtgttttaggtgcagttgtgccacaaaccttccctaaattatctaggtttgctttgatgaattaaattaaaatgagaaaagcaaaaagaaataaa

SEQ ID NO: 305904 - DNA, 741 bp, Homo sapiens
aaaaagaagcgatgctttctgtttcctagatataaatttacttcaacaccttttacactgaaagatattctcctaggagacagagaaatttcagctggtatttcatcttatcaattactgaattatgaagatgaatcagatgtttcactctatggaaggcgaggtaaccatattgtaaatgacgttgggattaacgttgctggatcagattccattgcagtgaaagcttcatttggtatagtaaccaaacatgaagtggaagtatcaacattactcaaagaaattactacacgaaaaattaactttgaccacagcttgatacgtcagtcaaggagcagcagaaaggcagtattgtgtgtggtcatggagagcatccgaaccacacgacagtgctcactgtctgtgcatgctggaattcgaggggaagcaatgcgggtaaaccacacttgttgggttctcttactaactaaagtgttgccatgggaatttttttaagtattgaatttctagtcaggcttgtgtattttgtgaaatgttctgatgaaagagctgcagttgtataggattttgcacagcaatgtctgttctagaatatgaaaaaaaaaaacaaatcttgggattctaaacatgtgtaatataatgcaaaaacagtaatccttgtgaaattacgtgcatactggagtccctcaagttactatttaagtgttgttttaagaataaaaattgagtgagttgaattga

SEQ ID NO: 305905 - DNA, 699 bp, Homo sapiens
gggaattatacagtggtaaactacttggtgaaaccatgctttgtatttttaagatgtataattatatttaaaaacaagcaatgcttaattttgtgcctgattttcctctttaaaaatggatttatctgggggttgcagttgatgacgttttgattttaatatgtttgctgctgctaccaagagctttgtcaagcaagttggagatggagggagattagttcctgttccaagcctcagtgaagctgacaaatatcaacctctaagtctggtggtaaaaaagaagcgatgctttctgtttcctagatataaatttacttcaacaccttttacactgaaagatattctcctaggagacagagaaatttcagctggtaagtttaaatgtttgggagtgccaactcattcatctgtattattggcaacctaaacataggtcatatatgctacttatgttagtaatacacattttcaatgattaaagcaacttttattatgatgttagtgtaataacattattaagattaacaatgccaaaagtttgtataatatcaaatctcttattggtcaaataattttcaaatctatcaattattttataaattgttttaaccaaatcaacttagaatatgacatatttcttcatctataaaatgggatattatttgggcttacctatgttacatggtcaaatgagatgaa

SEQ ID NO: 305906 - DNA, 398 bp, Homo sapiens
tagtggattcacatatttattaatgctgtttgcattatgtatttttcattttcacttctaacacatttcttttctgtttttgtccttttagatagaagagtgatggatgtcatttctcgttcacagctttacttggatgatcttttttctgactactatgacaaacctctcagcatgactgatatttcactcaaagaagggacccatatccgagttaacttacttaatcacaacattcccaaagggccttgcatactctgtggaatggggaacttcaaaagggagacagtttatgggtgctttcagtgttctgttgatggtcagaagtatgtgagacttcatgcagttccttgttttgatatttggcacaagaggatgaaataaaatgaaaaatgaat

SEQ ID NO: 305907 - DNA, 540 bp, Homo sapiens
gtggcattctttctcaaattgatgtaaagattcagtgcagtccctatcaaaagcctaaatggcttcttagcagaaattgtcgagcttatcttaaaattcatttgggaattaaaagaacccggaatagccgtaacagtcttgaaaaaaaaaaaaaaacaaagattaggactcacgcattctggtatcagaatttattacaaagctacattaatcaagactgtgatgctgccatgtggatagacatgtagatcagtggagtagaattgagaggccaaagataaaccttcatatttatggtcaattgatttctgacaaaaatgccaagagaattcaatgaggaaatttatgttttccaaccagtagtcctgggacggttattagacattgaaatgcaaaaagatgaagttccactcctgcctctctgtagacacacacaaaaaagtgaatcatgacctaaatgtaagagctgaaatcataaaactcttaaaggaaaacatgaggaaatcttcatgaccttgggttaggccatggtttctgaga

SEQ ID NO: 305908 - DNA, 1821 bp, Homo sapiens
gattatctgagcgatagcttgcaaggttatttatttattgccatgaggattatctggatgtgtagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccaggttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaaaaaa

SEQ ID NO: 305909 - DNA, 927 bp, Homo sapiens
  misc_feature (893)..(893): n is a, c, g, or t
  misc_feature (926)..(926): n is a, c, g, or t
gattatctgagcgatagcttgcaaggttatttatttattgccatgaggattatctggatgtgtagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactacttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataaggggtggaaaatcggcttcccgtttttccttggggccagccccttacattgggnaaaaattcaaggtccttctggctttaccaaccng

SEQ ID NO: 305910 - DNA, 281 bp, Homo sapiens
actgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtggtaagtcaaggcatgccaatttagtaagagttgtagaactggtaaaagaaaatatattctgttgattgacataataatt

SEQ ID NO: 305911 - DNA, 1966 bp, Homo sapiens
gattatctgagcgatagcttgcaaggttatttatttattgccatgaggattatctggatgtgtagcagattcatgcccaagcacaaaacaacccatttaaagaagatgctcggccttaaaggaaatggcggtgcggttctgtccatggcccttccttttcagccagagcagagagattcagaggatttattgaagaattttaattcagagtgtgatacacactgtggccttgatactgcacgacaagaatatttgggtaactcattaagacaggaatcagacttgaaaaaatccacctcgtcagataattcaagctctcatcatggtgaaaataaacaaaatctgactgttgatccctgtgacattttgggtggagttgataatcagcaaagactgctacacattgtctggcctcacaggtgggagcatgataaagatccagaaagcttttttaaggtattaatgcatcttaaagacttaggactcaatttccacgtgtctgtacttggagaaaccttcacagatgtcccagatattttttcagaggccaaaaaggcattgggatcttctgtcttacactggggctacttacccagcaaagatgactacttccaagtactgtgcatggctgatgttgtcatctcaacagctaagcatgaattctttggagtggcaatgttggaagctgtgtactgtgggtgttacccactttgtcctaaagatttggtttatcccgaaatatttccagctgaatatctgtattctacacctgaacagctttcaaaaaggctccagaatttctgcaagagaccagatattataagaaaacatctctataagggtgaaatcgctccgttttcttgggcagccctacatggtaaattcaggtctctgcttacaacagaacctagggaagatttgtgacagatggggctaagtcacaaacttgcagcctaaggcagaatctgaagaactttccagagtgtgcccatatttacctgatcagagagaaaagaaaatctgcagaggaagctgagcctggctgcttgtcatagctgacacagagccatctgccacaaacctgtggcggcttcagatctccaatccctgccaccaccccaactcaaattaaatacagattcctagagacgttatgatggttacacatgtcctcggcatcacatgtaggagactgttcaaaaaaaatatgtggcctgttgtataaccgcactcatgtatcccatatgtggtgccacattgaatttccggttgaatccgtttttatcctttgtactggatgacatggtgcctgaattctttcttttcgccgacacgatggcagccaaactgcagcttcaaacgctcacacttggctgggtttctacctaggttgccaggttatcatcggagccttcttgtgtcctcaaagggccacgaggcctgaaaggaggatcagaatgctttgggattaattgggcagccatcgcagaattgtttgtgggcaaagggctgctttagcacttttcttttagcaaattaatgactctcaggcacagggggttttaagtgaaggtattaataagaggtctggcaggtattcccatgattcacagagttacatttgcatttaattaatcttaaagttgcaagataaacagctgtaattcggacaaacatgacaaacacagtgaagccaactatcccataaaatgaacactgacatacttgttttaatttttttcccagcgtaaaaatagaaaaatcaaaatactcctaacaaaaccagtgattttgatagaaatatttctccaatatacttgcatccacctacaaatataaccttttcaagataaatcgcttatgatttcaatagtcaaactgctgtgtttgttgatgtaaagatgttttgaatggctagatggtaaaataaattcttaataaagtacccactgcaatttttaaaaaa

SEQ ID NO: 305912 - DNA, 917 bp, Homo sapiens
ggtttgcagagagttctcaagccttgaaatcatctctcttcacatctgacatgaacctccttctcaatagcatttctctcttaacttttctttcagaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatgctgtgggcgacaaggccgtggaattcttctttgcttctgatgcaagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggtacttcgtgcgttactcctgaagggcaccttcgacgcagaccgaatctgtttcacaaccaggggaggtggtgacattagaagcacagacagcctggtagatgactgacatgaaggaatacaagaagactctcctgtgctggaacctgtaactcagaacccaagttgagggagaatccgcagtgattcgagactgagaatcgc

SEQ ID NO: 305913 - DNA, 3023 bp, Homo sapiens
cgccctctcggagggctccgggttataagggctggaggccgagcggacgggagctggagcccgcggagcccgcggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaagggcctgcagcggctggagtacagaggctacgactcggcaggtgtggcgatcgatgggaataatcacgaagtcaaagaaagacacattcagctggtcaagaaaagggggaaagtcaaggctctcgatgaagaactttacaaacaagacagcatggacttaaaagtggagtttgagacacacttcggcattgcccacacgcgctgggccacccacggggtccccagtgctgtcaacagccaccctcagcgctcagacaaaggcaacgaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatgctgtgggcgacaaggccgtggaattcttctttgcttctgatgcaagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggtaacttcagtgcgtttatgcagaaggagatcttcgaacagccagaatcagttttcaatactatgagaggtcgggtgaattttgaaaccaacacagtgctcctgggtggcttgaaggaccacttgaaggagattcgacgatgccgacggctcatcgtgattggctgtggaaccagctaccacgctgccgtggctacgcggcaagttttggaggaactgactgagcttcctgtgatggttgaacttgctagtgattttctggacaggaacacacctgtgttcagggatgacgtttgctttttcatcagccagtcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggcttataccagtcagttcatctctctggtgatgtttggtttgatgatgtctgaagaccgaatttcactacaaaacaggaggcaagagatcatccgtggcttgagatctttacctgagctgatcaaggaagtgctgtctctggaggagaagatccacgacttggccctggagctctacacgcagagatcgctgctggtgatggggcggggctacaactatgccacctgcctggaaggagccctgaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccagggtcgccccattatactgtgctccaaggacgatactgaaagttccaagtttgcgtataagacaattgagctgccccacactgtggactgcctccagggcatcctgagcgtgattccgctgcagctgctgtccttccacctggctgttctccgaggatatgacgttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttt

SEQ ID NO: 305914 - DNA, 1650 bp, Homo sapiens
gtggggccgaggctggcggagcgcggcactgagagggcccctgggcggcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggcttataccagtcagttcatctctctggtgatgtttggtttgatgatgtctgaagaccgaatttcactacaaagctgatcaaggaagtgctgtctctggaggagaagatccacgacttggccctggagctctacacgcagagatcgctgctggtgatggggcggggctacaactatgccacctgcctggaaggagccctgaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccagggtcgccccattatactgtgctccaaggacgatactgaaagttccaagtttgcgtataagacaattgagctgccccacactgtggactgcctccagggcatcctgagcgtgattccgctgcagctgctgtccttccacctggctgttctccgaggatatgacgttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttt

SEQ ID NO: 305915 - DNA, 1400 bp, Homo sapiens
gccaggatgaccttgatctgacctcgtgatccacctgcctcagcctcccaaagtgctgggattacaggtgtgagccaccgcacccggcccagtagaagcgtacttatgaaccattcctacctttccttcccactccaccctaaacaaataagtcccatggaattcatatatattcttgcaagaaaagttaatttttaacagtacacaccaagttacctgtgtttaaaagcatgaaccttattctttaaatcatgttaacagatcatgacacacatcaggtgcacagtaaatgtttattgagggactaaaccttatacggttaaatgaggcttctggactaaggaatctgcctccaagacgcaggtctctaggttggtgaccatggtgaacatctgtctcttgtttttaagtactctgaaaattgtctgtgagaggtagcatgttgctgagatctttggggtcctgaacagtcactttctttcattttaggttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttt

SEQ ID NO: 305916 - DNA, 584 bp, Homo sapiens
tccttctggccacgctcttctggccacgccttctggccacgcttttaaatagagagcagagttgcccacttgaaactactctcttgcatgggatatttcaagctgttttactatgggcaaggagcagggaccaaaatgctgccagggcttaaaaagagccgtgatcagattaaacagaagtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttt

SEQ ID NO: 305917 - DNA, 2077 bp, Homo sapiens
cgccctctcggagggctccgggttataagggctggaggccgagcggacgggagctggagcccgcggagcccgcggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaagggcctgcagcggctggagtacagaggctacgactcggcaggtgtggcgatcgatgggaataatcacgaagtcaaagaaagacacattcagctggtcaagaaaagggggaaagtcaaggctctcgatgaagaactttacaaacaagacagcatggacttaaaagtggagtttgagacacacttcggcattgcccacacgcgctgggccacccacggggtccccagtgctgtcaacagccaccctcagcgctcagacaaaggcaacgaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgtaagtttctcaagaagtaccggaacagcacagctgctggtgtcgcaggactcggcagctgctctggcacagtcagctcccctctgaggcaaggaaaccccactctgagccagacccaacaggcgcacagctccaggtctaaaaggtttttgtgcaactgagacttggctccattttttttaagctttttatcatggacatgaatttatcatgattttgtatattgtcaaacatacacaaaagtgccattgtataacggcaactgggctttgatgtgagtgcttctttggtttgtttttgtttgcattcctctcacactgtagccatttaaatgcttttgcagtggtactgtgctattgggggatcttttacacaatttggctgacacagccaaagctaaaaattgcaaatttctcccacacatattcagaggggaaattggttccttgctgcatattatgcaaacaaaacatcccagtgggatttgcaacccattcctccatttgctaggcactctggagaatgtgaagaatatctgtaagacacggatgaagaggctggacagctccgcctgcctgcatgctgtgggcgacaaggccgtggaattcttctttgcttctgatgcaaggtaactgagccttcttctcttcgcttcctgggattacataatcaaagaatgcctgtctaaacactgccggttcttattcatccttccatgtgagctatcgtggctcagcaagtcgcagggccaaagaagagttcagccatccctgggcctgggcctggagtccttgtcctaggagcacctgcatgactgtggtaggcagccctggtggccaaaggccagatgcactggtgggcacagtgcttcgagcctgcacaaaatgaatgggttagttgccaatgttgtaaaatttggagatttcacagagaaatctgaaatctctagcttctctggaagaactagcagatcggggcatgctgtgcagccctctctcaggtggcaggtgtctggatctgctcaaaggctgccccctttagatgagacaactgtgtctagacctcagtccctcccatgcccctccctgcctttgcctggggtgagaccatttgtgaaagacagagccaagacacagggagtttttcaattgattctaaagtccatgctctcatcaatccactgaataatgattttgaaatttgagaaattctgctttatactcatttcaga

SEQ ID NO: 305918 - DNA, 303 bp, Homo sapiens
tgtgactctcactgccccgtctacccagctggcacccctgccgggctccctgtgggcctgggcaagccgcacatcgctcaccgtggaattcacatgttctggtttgtggtacttcccgtggcaccgtctgttttgctttccctcgtgatgtcaccccggatgcgctgttctgcactcagctccccgagggaccccaggacctcccgccatcaggaggggcccagggagacgcacctgggctgtggccaggctgcagcagcggctgctggaacgcgttgaccctcactgtttgtgtgttttcag

SEQ ID NO: 305919 - DNA, 199 bp, Homo sapiens
caacagagtagaccctgtctcaaaaataaaagttgatttaaaaagtgaaaataaggtccctgccacctccttctttgtgcacaggcttataccagtcagttcatctctctggtgatgtttggtttgatgatgtctgaagaccgaatttcactacaaaacaggaggcaagagatcatccgtggcttgagatctttacctg

SEQ ID NO: 305920 - DNA, 3085 bp, Homo sapiens
cgccctctcggagggctccgggttataagggctggaggccgagcggacgggagctggagcccgcggagcccgcggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaagggcctgcagcggctggagtacagaggctacgactcggcaggtgtggcgatcgatgggaataatcacgaagtcaaagaaagacacattcagctggtcaagaaaagggggaaagtcaaggctctcgatgaagaactttacaaacaagacagcatggacttaaaagtggagtttgagacacacttcggcattgcccacacgcgctgggccacccacggggtccccagtgctgtcaacagccaccctcagcgctcagacaaaggcaacgaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatgctgtgggcgacaaggccgtggaattcttctttgcttctgatgcaagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggtaacttcagtgcgtttatgcagaaggagatcttcgaacagccagaatcagttttcaatactatgagaggtcgggtgaattttgaaaccaacacagtgctcctgggtggcttgaaggaccacttgaaggagattcgacgatgccgacggctcatcgtgattggctgtggaaccagctaccacgctgccgtggctacgcggcaagttttggaggaactgactgagcttcctgtgatggttgaacttgctagtgattttctggacaggaacacacctgtgttcagggatgacgtttgctttttcatcagccagtcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggcttataccagtcagttcatctctctggtgatgtttggtttgatgatgtctgaagaccgaatttcactacaaaacaggaggcaagagatcatccgtggcttgagatctttacctgagctgatcaaggaagtgctgtctctggaggagaagatccacgacttggccctggagctctacacgcagagatcgctgctggtgatggggcggggctacaactatgccacctgcctggaaggagccctgaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccagggtcgccccattatactgtgctccaaggacgatactgaaagttccaagtttgcgtataagacaattgagctgccccacactgtggactgcctccagggcatcctgagcgtgattccgctgcagctgctgtccttccacctggctgttctccgaggatatgacgttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttt

SEQ ID NO: 305921 - DNA, 2671 bp, Homo sapiens
ggtttgcagagagttctcaagccttgaaatcatctctcttcacatctgacatgaacctccttctcaatagcatttctctcttaacttttctttcagaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatgctgtgggcgacaaggccgtggaattcttctttgcttctgatgcaagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggtaacttcagtgcgtttatgcagaaggagatcttcgaacagccagaatcagttttcaatactatgagaggtcgggtgaattttgaaaccaacacagtgctcctgggtggcttgaaggaccacttgaaggagattcgacgatgccgacggctcatcgtgattggctgtggaaccagctaccacgctgccgtggctacgcggcaagttttggaggaactgactgagcttcctgtgatggttgaacttgctagtgattttctggacaggaacacacctgtgttcagggatgacgtttgctttttcatcagccagtcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggcttataccagtcagttcatctctctggtgatgtttggtttgatgatgtctgaagaccgaatttcactacaaaacaggaggcaagagatcatccgtggcttgagatctttacctgagctgatcaaggaagtgctgtctctggaggagaagatccacgacttggccctggagctctacacgcagagatcgctgctggtgatggggcggggctacaactatgccacctgcctggaaggagccctgaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccagggtcgccccattatactgtgctccaaggacgatactgaaagttccaagtttgcgtataagacaattgagctgccccacactgtggactgcctccagggcatcctgagcgtgattccgctgcagctgctgtccttccacctggctgttctccgaggatatgacgttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttt

SEQ ID NO: 305922 - DNA, 2885 bp, Homo sapiens
cgactcccagttttcccaattaattgtcaattgcatctccccccacctctagtgaagagaggcagccccctgctcatcggagtccggagcaaatacaagctctccacagaacagatccctatcttatacaggacgtgtaagtttctcaagaagtaccggaacagcacagctgctggtgtcgcaggactcggcagctgctctggcacagtcagctcccctctgaggcaaggaaaccccactctgagccagacccaacaggcgcacagctccaggtctaaaaggtttttgtgcaactgagacttggctccattttttttaagctttttatcatggacatgaatttatcatgattttgtatattgtcaaacatacacaaaagtgccattgtataacggcaactgggctttgatgtgagtgcttctttggtttgtttttgtttgcattcctctcacactgtagccatttaaatgcttttgcagtggtactgtgctattgggggatcttttacacaatttggctgacacagccaaagctaaaaattgcaaatttctcccacacatattcagaggggaaattggttccttgctgcatattatgcaaacaaaacatcccagtgggatttgcaacccattcctccatttgctaggcactctggagaatgtgaagaatatctgtaagacacggatgaagaggctggacagctccgcctgcctgcatgctgtgggcgacaaggccgtggaattcttctttgcttctgatgcaagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggtaacttcagtgcgtttatgcagaaggagatcttcgaacagccagaatcagttttcaatactatgagaggtcgggtgaattttgaaaccaacacagtgctcctgggtggcttgaaggaccacttgaaggagattcgacgatgccgacggctcatcgtgattggctgtggaaccagctaccacgctgccgtggctacgcggcaagttttggaggaactgactgagcttcctgtgatggttgaacttgctagtgattttctggacaggaacacacctgtgttcagggatgacgtttgctttttcatcagccagtcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggcttataccagtcagttcatctctctggtgatgtttggtttgatgatgtctgaagaccgaatttcactacaaaacaggaggcaagagatcatccgtggcttgagatctttacctgagctgatcaaggaagtgctgtctctggaggagaagatccacgacttggccctggagctctacacgcagagatcgctgctggtgatggggcggggctacaactatgccacctgcctggaaggagccctgaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccagggtcgccccattatactgtgctccaaggacgatactgaaagttccaagtttgcgtataagacaattgagctgccccacactgtggactgcctccagggcatcctgagcgtgattccgctgcagctgctgtccttccacctggctgttctccgaggatatgacgttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttt

SEQ ID NO: 305923 - DNA, 1567 bp, Homo sapiens
cgccctctcggagggctccgggttataagggctggaggccgagcggacgggagctggagcccgcggagcccgcggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaagggcctgcagcggctggagtacagaggctacgactcggcaggtgtggcgatcgatgggaataatcacgaagtcaaagaaagacacattcagctggtcaagaaaagggggaaagtcaaggctctcgatgaagaactttacaaacaagacagcatggacttaaaagtggagtttgagacacacttcggcattgcccacacgcgctgggccacccacggggtccccagtgctgtcaacagccaccctcagcgctcagacaaaggcaacgaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatgctgtgggcgacaaggccgtggaattcttctttgcttctgatgcaaggtaactgagccttcttctcttcgcttcctgggattacataatcaaagaatgcctgtctaaacactgccggttcttattcatccttccatgtgagctatcgtggctcagcaagtcgcagggccaaagaagagttcagccatccctgggcctgggcctggagtccttgtcctaggagcacctgcatgactgtggtaggcagccctggtggccaaaggccagatgcactggtgggcacagtgcttcgagcctgcacaaaatgaatgggttagttgccaatgttgtaaaatttggagatttcacagagaaatctgaaatctctagcttctctggaagaactagcagatcggggcatgctgtgcagccctctctcaggtggcaggtgtctggatctgctcaaaggctgccccctttagatgagacaactgtgtctagacctcagtccctcccatgcccctccctgcctttgcctggggtgagaccatttgtgaaagacagagccaagacacagggagtttttcaattgattctaaagtccatgctctcatcaatccactgaataatgattttgaaatttgagaaattctgctttatactcatttcaga

SEQ ID NO: 305924 - DNA, 1201 bp, Homo sapiens
cgccctctcggagggctccgggttataagggctggaggccgagcggacgggagctggagcccgcggagcccgcggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaagggcctgcagcggctggagtacagaggctacgactcggcaggtgtggcgatcgatgggaataatcacgaagtcaaagaaagacacattcagctggtcaagaaaagggggaaagtcaaggctctcgatgaagaactttacaaacaagacagcatggacttaaaagtggagtttgagacacacttcggcattgcccacacgcgctgggccacccacggggtccccagtgctgtcaacagccaccctcagcgctcagacaaaggcaacgaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttt

SEQ ID NO: 305925 - DNA, 277 bp, Homo sapiens
agctagcgtgagaaatgacacggagcccttttatcttcgaggtggcctgtgggtgaccgaagtcccctcgccacctggacagtgaggttccgtgtcacaaactgtccctagaagcccagctgccccatgtccctgtcgtgcctgtgactgactttagtctccatgcttgcttgttggcttcagacgcggcaagttttggaggaactgactgagcttcctgtgatggttgaacttgctagtgattttctggacaggaacacacctgtgttcagggatg

SEQ ID NO: 305926 - DNA, 5573 bp, Homo sapiens
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgacccgtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccatgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctagcagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtccaggaccccggcagttggcttgt

SEQ ID NO: 305927 - DNA, 4392 bp, Homo sapiens
cgtggcttgtgggttgcctgtggcttgtggtgactgtggttgtgggttgactgtgcttggcatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgacccgtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccatgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctagcagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtccaggaccccggcagttggcttgt

SEQ ID NO: 305928 - DNA, 5468 bp, Homo sapiens
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgacccgtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccatgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctagcagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtccaggaccccggcagttggcttgt

SEQ ID NO: 305929 - DNA, 5489 bp, Homo sapiens
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggagatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgacccgtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccatgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctagcagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtccaggaccccggcagttggcttgt

SEQ ID NO: 305930 - DNA, 1608 bp, Homo sapiens
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctccccacagtggaattgttgaagtgtggcgagtctgtgctcgggacaataaagcttgtgacaggtccaggaccccggcagttggcttgt

SEQ ID NO: 305931 - DNA, 2931 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305932 - DNA, 331 bp, Homo sapiens
ggtggttcacatacacagcacagaggcacgggcaccatgggagagggcagcactcctgccttctgaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305933 - DNA, 288 bp, Homo sapiens
  misc_feature (257)..(257): n is a, c, g, or t
cgagctcggtaccccccgactagcccgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtcgggctgtcgggctntcgggggtaccagctcaattctatcatgtac

SEQ ID NO: 305934 - DNA, 900 bp, Homo sapiens
ctgtgtgtgggctcgggagggttctttactttctccggaaagcttcacaaggttccgattaaccccagtgctggggaggggcaggggaggaaggggactcggaagctggaggacgagaaagaagggaggcggaggaggcagaggtgtaggtgctggacggcatcgctgaacgtggtgtcctggcactgggcaagctgtcactaaataatgaataaatgacagcccttcccccttgccctccatggagtggatctggggtcagagtgggttggaggagactcctgaccctccttagagtccagtttccctggtaggcatcctgagatgacaccaggctgactgcctggcccagccccaggggattgagcaggtgggtcctggcgtccagcacggggcacatgacaggtcagcagggagcagggctgggcggccgccggcagagcctgtccccggcccaccctggcctcggtgctgcccttgacctgccccgtccctactgctgcaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggaggtacggggctcctggacaccggcctgccatgcccaggcccttgtggggtggggctgagctacggaggctgctggaggggatagtgtgtggtgagcacctgggagggctgccagggttggggtttgtggggcacaggcccgggtgaaggggctcagctccctgccatagccacttccaggtccaggggggccctgcgttgttcctcgctactgtgatgagctcagatggggagactgaggcgg

SEQ ID NO: 305935 - DNA, 2903 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgagggttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305936 - DNA, 3599 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggtaagccccctcagcagacccctgcactcttacatggctgggtcccggtgccaggcagcatgtgctgcagtggcgctatgcacgcctggcctgggtcatccttctaggcaccgcgtctgaagatcgagggaggaaggggcctgcgggtggtacaggaggcgggctgggaggtgtggtaccacaggagaccctgggcggtggcacgggcagggcccagtgcacagggatctgggcatggcgaggggatgagaagctgtggatacaagcccaggacatggggtggccccgcgggggctgggaaggctggcagatgttgggtgtgggtaccacccccctgcaggcgtcctggcggccgggtcaggctggattggacgtctgggttcccatgcgtgcctccacccgctaccaaggtggccaaccctcccttgagctggatgccggccacgtgctttgctgcacgggctggcgtggcctcgtgttgtgttgggggtctcgcaccttctgtggaaggtgccctgcctggcatgcgcggtgtctgctgcctcatggctgagcttccatcgggccgtgtgcctgtgaccagcctcctgggctctgtcacggctgcgctgtggctgtacgccgtggcgctgcagggctgtgcatggtgtgacccgaatcccttccaggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305937 - DNA, 3409 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggtcccctgacaagcccaccaggccccctgctgagatggctgtgaccctgggctgacccgcccagtggcacattgactccgcctggagctggggagaccagagaggccctgtggttggacggtggcctgggtgcgctgctcctgccctctccttgccctgcctcagctgctgcctgccagaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggaaactggctttgccaaggcccccgctgggacagactgtttctttcactgcagtcctgggagccgagggcaaggggacaggaaagaggaagtgacctcagagcctggtggcaccagcatcatgtccaggctggggggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305938 - DNA, 2697 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcagccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305939 - DNA, 3236 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagaaaaaaaaaaaggcacagaagacagacgaagaacacaatgtgttgtgtgtgcgcgactatggccacgctgcgaaagacggaccttcgaaaacgcacaaaaacggcgatggcgccagaagaggcgacacccgacacgatggtagaaacggaggcaacgatgtacgaaacgaggtagaccaccaacaaggacaacgagcgagcgagacaggagaaccaaagaggtcgagagaaaccacaccagataaaagaacagcgcggcgggtggaccagagcggaatgtgcgatcgaaagagcgcaccagcgcga

SEQ ID NO: 305940 - DNA, 2993 bp, Homo sapiens
gatggtggcagatactctggctgctacgtgagaacagtgtgccgatccctggggtttctcaaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305941 - DNA, 3112 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggtcccctgacaagcccaccaggccccctgctgagatggctgtgaccctgggctgacccgcccagtggcacattgactccgcctggagctggggagaccagagaggccctgtggttggacggtggcctgggtgcgctgctcctgccctctccttgccctgcctcagctgctgcctgccagaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305942 - DNA, 3137 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagaaaaaaaaaaaacaacacaaacaacaacacacccaaaaagagaaaaaaaaacgacacaaccacaaacacacaacaacaccaagaacacacacaagaccacaacaaaaacacgagccgcacaaccaccacacaaaaccacgcgaccgcgacggagcacacaagccacagaccgcggacgacccgcaagctacacacaacacagcgcac

SEQ ID NO: 305943 - DNA, 2654 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcataccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305944 - DNA, 2853 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305945 - DNA, 3105 bp, Homo sapiens
  misc_feature (397)..(397): n is a, c, g, or t
  misc_feature (427)..(427): n is a, c, g, or t
cgttccccctgctctcagcatatgtggggcgcctcagtgcccggcccaagctcaaggccttcctggcctcccctgagtacgtgtccggccacgtggccggacacgtacacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcttgcgtgatcggcctgaagaagaaggcggtggccttcagccccgtcactgagctcaagaaagacactgatttcnagcaccgcatgccacgggagcagtggtggntgagcctgcggctcatgctgaagatgctggcacaataccgcatcagtatggccgcctacgtgtcaggggagctggtggcggaagtgacccgccgcaccctgagcatggacaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305946 - DNA, 2938 bp, Homo sapiens
  misc_feature (397)..(397): n is a, c, g, or t
  misc_feature (427)..(427): n is a, c, g, or t
cgttccccctgctctcagcatatgtggggcgcctcagtgcccggcccaagctcaaggccttcctggcctcccctgagtacgtgtccggccacgtggccggacacgtacacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcttgcgtgatcggcctgaagaagaaggcggtggccttcagccccgtcactgagctcaagaaagacactgatttcnagcaccgcatgccacgggagcagtggtggntgagcctgcggctcatgctgaagatgctggcacaataccgcatcagtatggccgcctacgtgtcaggggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305947 - DNA, 2231 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaagcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305948 - DNA, 2882 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccctgcctcactgtgacctgctcctgcccacgtgcagcacctgtcaccttttctagaaataaaatcaccctgactgtggggtgcatcggtctccggaga

SEQ ID NO: 305949 - DNA, 2079 bp, Homo sapiens
tgacgcggtcgccaactatgaacactgcaaccgtggacatgcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305950 - DNA, 2296 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaagaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305951 - DNA, 2779 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagctgcagctcagggagacgagtgctgggatcaacttctgccggagtggctgtgttgagggggccggtggcccaggcccagtccagggtcaatgaaccgtacgggagttggcaatgtgagggccccgcgacgccggccttaaacggggggaaaagggcgggctttttgttgta

SEQ ID NO: 305952 - DNA, 3606 bp, Homo sapiens
  misc_feature (397)..(397): n is a, c, g, or t
  misc_feature (427)..(427): n is a, c, g, or t
cgttccccctgctctcagcatatgtggggcgcctcagtgcccggcccaagctcaaggccttcctggcctcccctgagtacgtgtccggccacgtggccggacacgtacacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcttgcgtgatcggcctgaagaagaaggcggtggccttcagccccgtcactgagctcaagaaagacactgatttcnagcaccgcatgccacgggagcagtggtggntgagcctgcggctcatgctgaagatgctggcacaataccgcatcagtatggccgcctacgtgtcaggggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggtaagccccctcagcagacccctgcactcttacatggctgggtcccggtgccaggcagcatgtgctgcagtggcgctatgcacgcctggcctgggtcatccttctaggcaccgcgtctgaagatcgagggaggaaggggcctgcgggtggtacaggaggcgggctgggaggtgtggtaccacaggagaccctgggcggtggcacgggcagggcccagtgcacagggatctgggcatggcgaggggatgagaagctgtggatacaagcccaggacatggggtggccccgcgggggctgggaaggctggcagatgttgggtgtgggtaccacccccctgcaggcgtcctggcggccgggtcaggctggattggacgtctgggttcccatgcgtgcctccacccgctaccaaggtggccaaccctcccttgagctggatgccggccacgtgctttgctgcacgggctggcgtggcctcgtgttgtgttgggggtctcgcaccttctgtggaaggtgccctgcctggcatgcgcggtgtctgctgcctcatggctgagcttccatcgggccgtgtgcctgtgaccagcctcctgggctctgtcacggctgcgctgtggctgtacgccgtggcgctgcagggctgtgcatggtgtgacccgaatcccttccaggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305953 - DNA, 1998 bp, Homo sapiens
cataatgtctatgtagaggctggcttaatcggcagaggcttggctctgctctggcctcaggggccgactggctgttcatccccgaggctccacccgaggacggctgggagaacttcatgtgtgagaggctgggtgagccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305954 - DNA, 2427 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305955 - DNA, 2517 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcctgcactccgccggccattgcactccggccagccttgcactccggccagccattgactccggccagccattgactccgg

SEQ ID NO: 305956 - DNA, 2489 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccggatgccagggagcaggggtggtgagccggggtcaatgctgaagaatggtgggcccataccggatcaagatggcgcctacgggtcggggagcggggccgggaccggcggaccctgagctggaagggtttgggggcggcaggcaaggcggtccaaggcacaacaaggcagggaggcagggtacgaggggctggtgtgggttggccggagaggg

SEQ ID NO: 305957 - DNA, 2353 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcacgctcgtctgagaagtcgagcacccgtctgacgtactcgagcacccgtcggtagaatcgagcaccctctgagaatgcg

SEQ ID NO: 305958 - DNA, 1874 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305959 - DNA, 1862 bp, Homo sapiens
ctgtgtgtgggctcgggagggttctttactttctccggaaagcttcacaaggttccgattaaccccagtgctggggaggggcaggggaggaaggggactcggaagctggaggacgagaaagaagggaggcggaggaggcagaggtgtaggtgctggacggcatcgctgaacgtggtgtcctggcactgggcaagctgtcactaaataatgaataaatgacagcccttcccccttgccctccatggagtggatctggggtcagagtgggttggaggagactcctgaccctccttagagtccagtttccctggtaggcatcctgagatgacaccaggctgactgcctggcccagccccaggggattgagcaggtgggtcctggcgtccagcacggggcacatgacaggtcagcagggagcagggctgggcggccgccggcagagcctgtccccggcccaccctggcctcggtgctgcccttgacctgccccgtccctactgctgcaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305960 - DNA, 2280 bp, Homo sapiens
  misc_feature (9)..(9): n is a, c, g, or t
  misc_feature (11)..(12): n is a, c, g, or t
  misc_feature (14)..(14): n is a, c, g, or t
  misc_feature (2076)..(2076): n is a, c, g, or t
  misc_feature (2280)..(2280): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaccggaagggcctggataataacccagggtcccggacaacggatccatcaagggagggggctcaacgggggaacaagtgtcggggtcaccgcacagggggggggccaaaacccctgtaggngacatgtggcaccggcggggagcagcccacggggtgggtgcaacacggcggggaacacgcgggagggagtgcagaccacacacgaagaggccacacaagaggggcgaccgagagaaaacgacgccagacccgactggacgggccgacgagacaaagaacaggagcgccagcagcaaagcaccaacgggtggcgcggcgccacgn

SEQ ID NO: 305961 - DNA, 1907 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgacgcgttcaacagcctgctcgggaccagggccgtgtggtctcgtgcgccctgggggtccccggggtcctgccccgcgctgcttgcggtggccgccccctagttcaggactacatctccattaggcgtgggctgggcagcccatcagggcgcgtgcgaacgcgtccggtcgggc

SEQ ID NO: 305962 - DNA, 1965 bp, Homo sapiens
  misc_feature (9)..(9): n is a, c, g, or t
  misc_feature (11)..(12): n is a, c, g, or t
  misc_feature (14)..(14): n is a, c, g, or t
  misc_feature (1812)..(1812): n is a, c, g, or t
  misc_feature (1826)..(1826): n is a, c, g, or t
  misc_feature (1836)..(1836): n is a, c, g, or t
  misc_feature (1949)..(1949): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagtgcgtgcagatgaccaaggaagtgcagaaagccatggatgacaagaggtttgacgaggccacccagctccgtggtgggagcttcnagaacaactggaanatttacaagnctcctcgcccaccaagaaagccccccaaggagaagtctaacttctccctgggcatcctgaattgtgggggccccggcggctgggcatggaatgcggccgtgcgcttcggggtngcggacccggcatctc

SEQ ID NO: 305963 - DNA, 1969 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggaggtacggggctcctggacaccggcctgccatgcccaggcccttgtggggtggggctgagctacggaggctgctggaggggatagtgtgtggtgagcacctgggagggctgccagggttggggtttgtggggcacaggcccgggtgaaggggctcagctccctgccatagccacttccaggtccaggggggccctgcgttgttcctcgctactgtgatgagctcagatggggagactgaggcgg

SEQ ID NO: 305964 - DNA, 1368 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccagacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305965 - DNA, 1150 bp, Homo sapiens
  misc_feature (9)..(9): n is a, c, g, or t
  misc_feature (11)..(12): n is a, c, g, or t
  misc_feature (14)..(14): n is a, c, g, or t
  misc_feature (921)..(921): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacnggggtccgacggcggggattaaaaccggggaaaggggcggggccgctgcaacggggaggacagccactgacttggaagggccggaagcaacaggcattagggcataagcgctgttgaaccacctcgcaccgctaggtgcacatcgaggaaaaagagggcgcacgagggaagaagcaagaagaaaggacacggaggacacacgggacaccaggagcaccaacgagatgtg

SEQ ID NO: 305966 - DNA, 839 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaagcctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305967 - DNA, 487 bp, Homo sapiens
cgagctcggtaccccccgactagcccgccagggctcagatggggcctgggctgttgtgtctggagcctgcaggcaggtgggggctgcgtccctgctcagcccatcccctgcctctatccctggccacctgccaggcctccctccggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggaga

SEQ ID NO: 305968 - DNA, 686 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagccttacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccaaccaccaaagtggtgttggtggtgatgatcaggacaccagtaattaccttagttagcttgtaccagcaccttggagtttctca

SEQ ID NO: 305969 - DNA, 947 bp, Homo sapiens
  misc_feature (9)..(9): n is a, c, g, or t
  misc_feature (11)..(12): n is a, c, g, or t
  misc_feature (14)..(14): n is a, c, g, or t
caggctagntnngngccggggttaatcggccgaggggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggtcccctgacaagcccaccaggccccctgctgagatggctgtgaccctgggctgacccgcccagtggcacattgactccgcctggagctggggagaccagagaggccctgtggttggacggtggcctgggtgcgctgctcctgccctctccttgccctgcctcagctgctgcctgccagaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggaaactggctttgccaaggcccccgctgggacagactgtttctttcactgcagtcctgggagccgagggcaaggggacaggaaagaggaagtgacctcagagcctggtggcaccagcatcatgtccaggctggggggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctggtgaggcctgggaacgcggatgcatgttgcacttggactcgcagacagacacacagagacagacctgcacacacagacacacacacagagacagacacgtgcacaaacacacacatgcagacacacagacatgcacacagacgcacacacacaca

SEQ ID NO: 305970 - DNA, 720 bp, Homo sapiens
gccagggcggctttcctgggagctgccactccctctcccaggcctggcccagcggggactcaggatcggggggagacctgaactcgttcccgccgactcaggccctgctgcccctctcaggaacgagaagtgccatgactactacaccacggagttcctgtacaacctgtactcatcagagggcaagggcgtcttcgactgcaggaccaatgtcctgggccacctgcagcaggtgtggggcaggggtgaggctctgagaggcctgcccctctttcctgccaccatctgtccccggccccaggggtcccagccctcacgggcacccacgggcactcccggcaggccctcgggcacgtgtgcccttccccagtgaggggaccgaggcctgtatctaggtgaggtctcatttcaagaaggggtggggctggggctggagccggggcccgagccagggcattcacatgctgagccgagctccccacccctgccaggcctcccgcggccacttccgccgaacccctcacctagatccccgcatgctccctgccttatggtggccctgcaggaagcccgcgtcctggggttttctgagccagggaggggagtcagggtggctgggcatggggcccgaggtgatggggcccgaggtggggccgctggctgccgatgcagggcccaggagtcacttgacttggccaggggcagccgactgccggcctc

SEQ ID NO: 305971 - DNA, 4024 bp, Homo sapiens
  misc_feature (8)..(8): n is a, c, g, or t
ggaacggngccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcaccccttgtccacagcctaagatggcggcgagggggacggtgaaggttgcctcccgcccgtccgggctctgatcctccgtctccccgtcccccggcggccggcccatggcctggcggaggcccgaaccatggacctccgcaccgccgtgtacaacgccgcccgtgatggcaagctgcagctgctccagaagctgctcagcggccggagccgggaggaactggacgagctgacgggcgaggtggccggcgggggaacgccgctactcatcgccgcccgctacggccacctggacgtggtggagtacctggtggaccggtgcggcgcgagcgtggaggccggtggctcggtgcacttcgatggcgagaccatcgagggcgcgccgccgctgtgggccgcctccgcagccggccacctggacgtggtgcggagcctgctgcgccgcggggcctcggtgaaccgcaccacgcgcaccaactccacgcctctccgcgccgcctgcttcgacggccacctggaggtggtgcgctacctggtcggcgagcaccaggccgacctggaggtggccaaccggcacggccacacgtgcctcatgatctcgtgctacaagggccaccgtgagatcgcccgctacctgctggagcagggcgcccaggtgaaccggcgcagcgccaagggcaacacggccctgcatgactgcgccgagtccggcagcctggagatcctgcagctgctgctggggtgcaaggcccgcatggaacgtgacggctacggcatgaccccgctgctcgcggccagcgtgacgggccacaccaacatcgtggagtacctcatccaggagcagcccggccaggagcaggtcgcagggggagaggctcagcctgggctgccccaagaagacccctccaccagccaggggtgtgcgcagcctcagggggctccgtgctgcagctcctccccagaggaaccactgaacggggaatcttacgaaagctgctgtcccaccagccgggaagctgccgtggaagccttggaattgctgggagctacgtatgtggataagaaacgagatctgcttggggcccttaaacactggaggcgggccatggagctgcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccgggccgccaaaggcagcctgggcacccagatcggctttgcagacctcatgggggttctcaccaaaggggtccgggaagtggaacgggccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcacccctctgcacatggctgtggacaaggacaccacaaacgtgggccgctatcccgtgggcagattcccctccctgcacgtggtcaaagtgctgctcgactgcggggccgacccggacagcagggattttgacaacaacaccccgctacacatagcagcccagaacaactgcccggccatcatgaatgccctgatcgaagcaggggcccacatggacgccaccaatgccttcaagaagacggcctacgagctgctggacgagaagctgctggccaggggtaccatgcagcccttcaactacgtgaccctgcagtgccttgcggcccgggccctggataagaacaagatcccttacaagggcttcatcccggaagatctggaggcgttcatcgaactgcactgacctgcccagaacgcctgcaccctcacctctcccctctcctgctgagatgggggaaatccggctgcggcatagcagatgctcgttcttgcctccttcaggcaccaatcaggagaagggttctgcctcccatcccctctacctgcagacagggtcggaggtgttagcgagcctttggtgctagaagcctgcggggtcatgtgctaagaggacagtctttctccgggagcccgctcactcattctgagttaggaaaagacacaagaccttccccacatcctgtctgcctgggttagggaggcctttgccttgttacctagaggcggagggactgaagccattgcgttccttccctgctagaaacacaggaagaagttgaggacggtctgccttccctcgtccctttacctggccagataactccagccgctgaatacagtgttaggactgggggctcctgagatgagagtttgagattcagggaatgagaccacctctcatttcttccagcatgatcgcgccctgctcccgtgccaccgtagtccctggcagacaggcagggctctgcccagggcagcctgccacttgcatagctttcggttggtttggtgttctgtttatttaataagtgggcaggttgcaagcgttgcacagaaattctgagattttactgccttttttttttttttttaagaaagttgtttgttggactccataagtgaatttcaagcagtgaggattttgtggtgcctgagatggccgagggcacagggagtgagctgtatgtgtgaggaatttggtgagcgagataaaagtccacggtgtcaacccctaaaacatgggtgaccgtacatttttatacatctccactctacggccttttacaggctttccgattttacaggcctttccaagtttccattctccttagagagagaactgtgcttccaaacagaaatcaggagtgaccacaaagcctgaaaacactttgccacccagcaaagaactggcacaattggtttgggtctgcattgccatagtgcccgagttaaaactgcaggccactctgccttgcaaacctcacgtggcctctgatttcattgtgggtgcatccacaggtggcccgagctgttctttcagctgctccaaggattgagacccaagtcatcatgaaaaaggcccaagtacagtcttaatgcgataaatccactagctaagacgtcgagtgccaagaccagccttccagccgaggtttggacaaagtctcaggttcccgtgactcagggtaaggtgctggggctgccagaggacctgccccagcaagatttttgtcaagagcgagactccatcagcccaggcagacgggagcaggttcttggccagcgtagacagcagcaaacagcagcagggaagccattctcactgcatcctccctgcagtagccacggccaggcccttaggaggagcagtgaccgggggtgtccagaaatatcctgtccctggatggaaactaggtctcgtttggattttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaag

SEQ ID NO: 305972 - DNA, 3966 bp, Homo sapiens
  misc_feature (8)..(8): n is a, c, g, or t
ggaacggngccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcaccccttgtccacagcctaagatggcggcgagggggacggtgaaggttgcctcccgcccgtccgggctctgatcctccgtctccccgtcccccggcggccggcccatggcctggcggaggcccgaaccatggacctccgcaccgccgtgtacaacgccgcccgtgatggcaagctgcagctgctccagaagctgctcagcggccggagccgggaggaactggacgagctgacgggcgaggtggccggcgggggaacgccgctactcatcgccgcccgctacggccacctggacgtggtggagtacctggtggaccggtgcggcgcgagcgtggaggccggtggctcggtgcacttcgatggcgagaccatcgagggcgcgccgccgctgtgggccgcctccgcagccggccacctggacgtggtgcggagcctgctgcgccgcggggcctcggtgaaccgcaccacgcgcaccaactccacgcctctccgcgccgcctgcttcgacggccacctggaggtggtgcgctacctggtcggcgagcaccaggccgacctggaggtggccaaccggcacggccacacgtgcctcatgatctcgtgctacaagggccaccgtgagatcgcccgctacctgctggagcagggcgcccaggtgaaccggcgcagcgccaagggcaacacggccctgcatgactgcgccgagtccggcagcctggagatcctgcagctgctgctggggtgcaaggcccgcatggaacgtgacggctacggcatgaccccgctgctcgcggccagcgtgacgggccacaccaacatcgtggagtacctcatccaggagcagcccggccaggagcaggtcgcagggggagaggctcagcctgggctgccccaagaagacccctccaccagccaggggtgtgcgcagcctcagggggctccgtgctgcagctcctccccagaggaaccactgaacggggaatcttacgaaagctgctgtcccaccagccgggaagctgccgtggaagccttggaattgctgggagctacgtatgtggataagaaacgagatctgcttggggcccttaaacactggaggcgggccatggagctgcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccgggccgccaaaggcagcctgggcacccagatcggctttgcagacctcatgggggttctcaccaaaggggtccgggaagtggaacgggccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcacccctctgcacatggctgtggacaaggacaccacaaacgtgggccgctatcccgtgggcagattcccctccctgcacgtggtcaaagtgctgctcgactgcggggccgacccggacagcagggattttgacaacaacaccccgctacacatagcagcccagaacaactgcccggccatcatgaatgccctgatcgaagcaggggcccacatggacgccaccaatgccttcaagaagacggcctacgagctgctggacgagaagctgctggccaggggtaccatgcagcccttcaactacgtgaccctgcagtgccttgcggcccgggccctggataagaacaagatcccttacaagggcttcatcccggaagatctggaggcgttcatcgaactgcactgacctgcccagaacgcctgcaccctcacctctcccctctcctgctgagatgggggaaatccggctgcctcccatcccctctacctgcagacagggtcggaggtgttagcgagcctttggtgctagaagcctgcggggtcatgtgctaagaggacagtctttctccgggagcccgctcactcattctgagttaggaaaagacacaagaccttccccacatcctgtctgcctgggttagggaggcctttgccttgttacctagaggcggagggactgaagccattgcgttccttccctgctagaaacacaggaagaagttgaggacggtctgccttccctcgtccctttacctggccagataactccagccgctgaatacagtgttaggactgggggctcctgagatgagagtttgagattcagggaatgagaccacctctcatttcttccagcatgatcgcgccctgctcccgtgccaccgtagtccctggcagacaggcagggctctgcccagggcagcctgccacttgcatagctttcggttggtttggtgttctgtttatttaataagtgggcaggttgcaagcgttgcacagaaattctgagattttactgccttttttttttttttttaagaaagttgtttgttggactccataagtgaatttcaagcagtgaggattttgtggtgcctgagatggccgagggcacagggagtgagctgtatgtgtgaggaatttggtgagcgagataaaagtccacggtgtcaacccctaaaacatgggtgaccgtacatttttatacatctccactctacggccttttacaggctttccgattttacaggcctttccaagtttccattctccttagagagagaactgtgcttccaaacagaaatcaggagtgaccacaaagcctgaaaacactttgccacccagcaaagaactggcacaattggtttgggtctgcattgccatagtgcccgagttaaaactgcaggccactctgccttgcaaacctcacgtggcctctgatttcattgtgggtgcatccacaggtggcccgagctgttctttcagctgctccaaggattgagacccaagtcatcatgaaaaaggcccaagtacagtcttaatgcgataaatccactagctaagacgtcgagtgccaagaccagccttccagccgaggtttggacaaagtctcaggttcccgtgactcagggtaaggtgctggggctgccagaggacctgccccagcaagatttttgtcaagagcgagactccatcagcccaggcagacgggagcaggttcttggccagcgtagacagcagcaaacagcagcagggaagccattctcactgcatcctccctgcagtagccacggccaggcccttaggaggagcagtgaccgggggtgtccagaaatatcctgtccctggatggaaactaggtctcgtttggattttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaag

SEQ ID NO: 305973 - DNA, 1184 bp, Homo sapiens
  misc_feature (12)..(12): n is a, c, g, or t
ttctagctcggnacccatcctccctctctcacgcaggcagggctctgcccagggcagcctgccacttgcatagctttcggttggtttggtgttctgtttatttaataagtgggcaggttgcaagcgttgcacagaaattctgagattttactgccttttttttttttttttaagaaagttgtttgttggactccataagtgaatttcaagcagtgaggattttgtggtgcctgagatggccgagggcacagggagtgagctgtatgtgtgaggaatttggtgagcgagataaaagtccacggtgtcaacccctaaaacatgggtgaccgtacatttttatacatctccactctacggccttttacaggctttccgattttacaggcctttccaagtttccattctccttagagagagaactgtgcttccaaacagaaatcaggagtgaccacaaagcctgaaaacactttgccacccagcaaagaactggcacaattggtttgggtctgcattgccatagtgcccgagttaaaactgcaggccactctgccttgcaaacctcacgtggcctctgatttcattgtgggtgcatccacaggtggcccgagctgttctttcagctgctccaaggattgagacccaagtcatcatgaaaaaggcccaagtacagtcttaatgcgataaatccactagctaagacgtcgagtgccaagaccagccttccagccgaggtttggacaaagtctcaggttcccgtgactcagggtaaggtgctggggctgccagaggacctgccccagcaagatttttgtcaagagcgagactccatcagcccaggcagacgggagcaggttcttggccagcgtagacagcagcaaacagcagcagggaagccattctcactgcatcctccctgcagtagccacggccaggcccttaggaggagcagtgaccgggggtgtccagaaatatcctgtccctggatggaaactaggtctcgtttggattttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaag

SEQ ID NO: 305974 - DNA, 3849 bp, Homo sapiens
  misc_feature (8)..(8): n is a, c, g, or t
ggaacggngccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcaccccttgtccacagcctaagatggcggcgagggggacggtgaaggttgcctcccgcccgtccgggctctgatcctccgtctccccgtcccccggcggccggcccatggcctggcggaggcccgaaccatggacctccgcaccgccgtgtacaacgccgcccgtgatggcaagctgcagctgctccagaagctgctcagcggccggagccgggaggaactggacgagctgacgggcgaggtggccggcgggggaacgccgctactcatcgccgcccgctacggccacctggacgtggtggagtacctggtggaccggtgcggcgcgagcgtggaggccggtggctcggtgcacttcgatggcgagaccatcgagggcgcgccgccgctgtgggccgcctccgcagccggccacctggacgtggtgcggagcctgctgcgccgcggggcctcggtgaaccgcaccacgcgcaccaactccacgcctctccgcgccgcctgcttcgacggccacctggaggtggtgcgctacctggtcggcgagcaccaggccgacctggaggtggccaaccggcacggccacacgtgcctcatgatctcgtgctacaagggccaccgtgagatcgcccgctacctgctggagcagggcgcccaggtgaaccggcgcagcgccaagggcaacacggccctgcatgactgcgccgagtccggcagcctggagatcctgcagctgctgctggggtgcaaggcccgcatggaacgtgacggctacggcatgaccccgctgctcgcggccagcgtgacgggccacaccaacatcgtggagtacctcatccaggagcagcccggccaggagcaggtcgcagggggagaggctcagcctgggctgccccaagaagacccctccaccagccaggggtgtgcgcagcctcagggggctccgtgctgcagctcctccccagaggaaccactgaacggggaatcttacgaaagctgctgtcccaccagccgggaagctgccgtggaagccttggaattgctgggagctacgtatgtggataagaaacgagatctgcttggggcccttaaacactggaggcgggccatggagctgcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccgggccgccaaaggcagcctgggcacccagatcggctttgcagacctcatgggggttctcaccaaaggggtccgggaagtggaacgggccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcacccctctgcacatggctgtggacaaggacaccacaaacgtgggccgctatcccgtgggcagattcccctccctgcacgtggtcaaagtgctgctcgactgcggggccgacccggacagcagggattttgacaacaacaccccgctacacatagcagcccagaacaactgcccggccatcatgaatgccctgatcgaagcaggggcccacatggacgccaccaatgccttcaagaagacggcctacgagctgctggacgagaagctgctggccaggggtaccatgcagcccttcaactacgtgaccctgcagtgccttgcggcccgggccctggataagaacaagatcccttacaagggcttcatcccggaagatctggaggcgttcatcgaactgcactgacctgcccagaacgcctgcaccctcacctctcccctctcctgctgagatgggggaaatccggctgcggcatagcagatgctcgttcttgcctccttcaggcaccaatcaggagaagggttctgcctcccatcccctctacctgcagacagggtcggaggtgttagcgagcctttggtgctagaagcctgcggggtcatgtgctaagaggacagtctttctccgggagcccgctcactcattctgagttaggaaaagacacaagaccttccccacatcctgtctgcctgggttagggaggcctttgccttgttacctagaggcggagggactgaagccattgcgttccttccctgctagaaacacaggaagaagttgaggacggtctgccttccctcgtccctttacctggccagataactccagccgctgaatacagtgttaggactgggggctcctgagatgagagtttgagattcagggaatgagaccacctctcatttcttccagcatgatcgcgccctgctcccgtgccaccgtagtccctggcagacaggcagggctctgcccagggcagcctgccacttgcatagctttcggttggtttggtgttctgtttatttaataagtgggcaggttgcaagcgttgcacagaaattctgagattttactgccttttttttttttttttaagaaagttgtttgttggactccataagtgaatttcaagcagtgaggattttgtggtgcctgagatggccgagggcacagggagtgagctgtatgtgtgaggaatttggtgagcgagataaaagtccacggtgtcaacccctaaaacatgggtgaccgtacatttttatacatctccactctacggccttttacaggctttccgattttacaggcctttccaagtttccattctccttagagagagaactgtgcttccaaacagaaatcaggagtgaccacaaagcctgaaaacactttgccacccagcaaagaactggcacaattggtttgggtctgcattgccatagtgcccgagttaaaactgcaggccactctgccttgcaaacctcacgtggcctctgatttcattgtgggtgcatccacaggtggcccgagctgttctttcagctgctccaaggattgagacccaagtcatcatgaaaaaggcccaagtacagtcttaatgcgataaatccactagctaagacgtcgagtgccaagaccagccattctcactgcatcctccctgcagtagccacggccaggcccttaggaggagcagtgaccgggggtgtccagaaatatcctgtccctggatggaaactaggtctcgtttggattttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaag

SEQ ID NO: 305975 - DNA, 3153 bp, Homo sapiens
  misc_feature (8)..(8): n is a, c, g, or t
ggaacggngccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcaccccttgtccacagcctaagatggcggcgagggggacggtgaaggttgcctcccgcccgtccgggctctgatcctccgtctccccgtcccccggcggccggcccatggcctggcggaggcccgaaccatggacctccgcaccgccgtgtacaacgccgcccgtgatggcaagctgcagctgctccagaagctgctcagcggccggagccgggaggaactggacgagctgacgggcgaggtggccggcgggggaacgccgctactcatcgccgcccgctacggccacctggacgtggtggagtacctggtggaccggtgcggcgcgagcgtggaggccggtggctcggtgcacttcgatggcgagaccatcgagggcgcgccgccgctgtgggccgcctccgcagccggccacctggacgtggtgcggagcctgctgcgccgcggggcctcggtgaaccgcaccacgcgcaccaactccacgcctctccgcgccgcctgcttcgacggccacctggaggtggtgcgctacctggtcggcgagcaccaggccgacctggaggtggccaaccggcacggccacacgtgcctcatgatctcgtgctacaagggccaccgtgagatcgcccgctacctgctggagcagggcgcccaggtgaaccggcgcagcgccaagggcaacacggccctgcatgactgcgccgagtccggcagcctggagatcctgcagctgctgctggggtgcaaggcccgcatggaacgtgacggctacggcatgaccccgctgctcgcggccagcgtgacgggccacaccaacatcgtggagtacctcatccaggagcagcccggccaggagcaggtcgcagggggagaggctcagcctgggctgccccaagaagacccctccaccagccaggggtgtgcgcagcctcagggggctccgtgctgcagctcctccccagaggaaccactgaacggggaatcttacgaaagctgctgtcccaccagccgggaagctgccgtggaagccttggaattgctgggagctacgtatgtggataagaaacgagatctgcttggggcccttaaacactggaggcgggccatggagctgcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccgggccgccaaaggcagcctgggcacccagatcggctttgcagacctcatgggggttctcaccaaaggggtccgggaagtggaacgggccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcacccctctgcacatggctgtggacaaggacaccacaaacgtgggccgctatcccgtgggcagattcccctccctgcacgtggtcaaagtgctgctcgactgcggggccgacccggacagcagggattttgacaacaacaccccgctacacatagcagcccagaacaactgcccggccatcatgaatgccctgatcgaagcaggggcccacatggacgccaccaatgccttcaagaagacggcctacgagctgctggacgagaagctgctggccaggggtaccatgcagcccttcaactacgtgaccctgcagtgccttgcggcccgggccctggataagaacaagatcccttacaagggcttcatcccggaagatctggaggcgttcatcgaactgcactgacctgcccagaacgcctgcaccctcacctctcccctctcctgctgagatgggggaaatccggctgcggcatagcagatgctcgttcttgcctccttcaggcaccaatcaggagaagggttctgcctcccatcccctctacctgcagacagggtcggaggtgttagcgagcctttggtgctagaagcctgcggggtcatgtgctaagaggacagtctttctccgggagcccgctcactcattctgagttaggaaaagacacaagaccttccccacatcctgtctgcctgggttagggaggcctttgccttgttacctagaggcggagggactgaagccattgcgttccttccctgctagaaacacaggaagaagttgaggacggtctgccttccctcgtccctttacctggccagataactccagccgctgaatacagtgttaggactgggggctcctgagatgagagtttgagattcagggaatgagaccacctctcatttcttccagagcgtagacagcagcaaacagcagcagggaagccattctcactgcatcctccctgcagtagccacggccaggcccttaggaggagcagtgaccgggggtgtccagaaatatcctgtccctggatggaaactaggtctcgtttggattttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaag

SEQ ID NO: 305976 - DNA, 3095 bp, Homo sapiens
  misc_feature (8)..(8): n is a, c, g, or t
ggaacggngccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcaccccttgtccacagcctaagatggcggcgagggggacggtgaaggttgcctcccgcccgtccgggctctgatcctccgtctccccgtcccccggcggccggcccatggcctggcggaggcccgaaccatggacctccgcaccgccgtgtacaacgccgcccgtgatggcaagctgcagctgctccagaagctgctcagcggccggagccgggaggaactggacgagctgacgggcgaggtggccggcgggggaacgccgctactcatcgccgcccgctacggccacctggacgtggtggagtacctggtggaccggtgcggcgcgagcgtggaggccggtggctcggtgcacttcgatggcgagaccatcgagggcgcgccgccgctgtgggccgcctccgcagccggccacctggacgtggtgcggagcctgctgcgccgcggggcctcggtgaaccgcaccacgcgcaccaactccacgcctctccgcgccgcctgcttcgacggccacctggaggtggtgcgctacctggtcggcgagcaccaggccgacctggaggtggccaaccggcacggccacacgtgcctcatgatctcgtgctacaagggccaccgtgagatcgcccgctacctgctggagcagggcgcccaggtgaaccggcgcagcgccaagggcaacacggccctgcatgactgcgccgagtccggcagcctggagatcctgcagctgctgctggggtgcaaggcccgcatggaacgtgacggctacggcatgaccccgctgctcgcggccagcgtgacgggccacaccaacatcgtggagtacctcatccaggagcagcccggccaggagcaggtcgcagggggagaggctcagcctgggctgccccaagaagacccctccaccagccaggggtgtgcgcagcctcagggggctccgtgctgcagctcctccccagaggaaccactgaacggggaatcttacgaaagctgctgtcccaccagccgggaagctgccgtggaagccttggaattgctgggagctacgtatgtggataagaaacgagatctgcttggggcccttaaacactggaggcgggccatggagctgcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccgggccgccaaaggcagcctgggcacccagatcggctttgcagacctcatgggggttctcaccaaaggggtccgggaagtggaacgggccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcacccctctgcacatggctgtggacaaggacaccacaaacgtgggccgctatcccgtgggcagattcccctccctgcacgtggtcaaagtgctgctcgactgcggggccgacccggacagcagggattttgacaacaacaccccgctacacatagcagcccagaacaactgcccggccatcatgaatgccctgatcgaagcaggggcccacatggacgccaccaatgccttcaagaagacggcctacgagctgctggacgagaagctgctggccaggggtaccatgcagcccttcaactacgtgaccctgcagtgccttgcggcccgggccctggataagaacaagatcccttacaagggcttcatcccggaagatctggaggcgttcatcgaactgcactgacctgcccagaacgcctgcaccctcacctctcccctctcctgctgagatgggggaaatccggctgcctcccatcccctctacctgcagacagggtcggaggtgttagcgagcctttggtgctagaagcctgcggggtcatgtgctaagaggacagtctttctccgggagcccgctcactcattctgagttaggaaaagacacaagaccttccccacatcctgtctgcctgggttagggaggcctttgccttgttacctagaggcggagggactgaagccattgcgttccttccctgctagaaacacaggaagaagttgaggacggtctgccttccctcgtccctttacctggccagataactccagccgctgaatacagtgttaggactgggggctcctgagatgagagtttgagattcagggaatgagaccacctctcatttcttccagagcgtagacagcagcaaacagcagcagggaagccattctcactgcatcctccctgcagtagccacggccaggcccttaggaggagcagtgaccgggggtgtccagaaatatcctgtccctggatggaaactaggtctcgtttggattttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaag

SEQ ID NO: 305977 - DNA, 2474 bp, Homo sapiens
  misc_feature (8)..(8): n is a, c, g, or t
ggaacggngccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcaccccttgtccacagcctaagatggcggcgagggggacggtgaaggttgcctcccgcccgtccgggctctgatcctccgtctccccgtcccccggcggccggcccatggcctggcggaggcccgaaccatggacctccgcaccgccgtgtacaacgccgcccgtgatggcaagctgcagctgctccagaagctgctcagcggccggagccgggaggaactggacgagctgacgggcgaggtggccggcgggggaacgccgctactcatcgccgcccgctacggccacctggacgtggtggagtacctggtggaccggtgcggcgcgagcgtggaggccggtggctcggtgcacttcgatggcgagaccatcgagggcgcgccgccgctgtgggccgcctccgcagccggccacctggacgtggtgcggagcctgctgcgccgcggggcctcggtgaaccgcaccacgcgcaccaactccacgcctctccgcgccgcctgcttcgacggccacctggaggtggtgcgctacctggtcggcgagcaccaggccgacctggaggtggccaaccggcacggccacacgtgcctcatgatctcgtgctacaagggccaccgtgagatcgcccgctacctgctggagcagggcgcccaggtgaaccggcgcagcgccaagggcaacacggccctgcatgactgcgccgagtccggcagcctggagatcctgcagctgctgctggggtgcaaggcccgcatggaacgtgacggctacggcatgaccccgctgctcgcggccagcgtgacgggccacaccaacatcgtggagtacctcatccaggagcagcccggccaggagcaggtcgcagggggagaggctcagcctgggctgccccaagaagacccctccaccagccaggggtgtgcgcagcctcagggggctccgtgctgcagctcctccccagaggaaccactgaacggggaatcttacgaaagctgctgtcccaccagccgggaagctgccgtggaagccttggaattgctgggagctacgtatgtggataagaaacgagatctgcttggggcccttaaacactggaggcgggccatggagctgcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccgggccgccaaaggcagcctgggcacccagatcggctttgcagacctcatgggggttctcaccaaaggggtccgggaagtggaacgggccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcacccctctgcacatggctgtggacaaggacaccacaaacgtgggccgctatcccgtgggcagattcccctccctgcacgtggtcaaagtgctgctcgactgcggggccgacccggacagcagggattttgacaacaacaccccgctacacatagcagcccagaacaactgcccggccatcatgaatgccctgatcgaagcaggggcccacatggacgccaccaatgccttagcgtagacagcagcaaacagcagcagggaagccattctcactgcatcctccctgcagtagccacggccaggcccttaggaggagcagtgaccgggggtgtccagaaatatcctgtccctggatggaaactaggtctcgtttggattttttttttttttttgccgtgttaggaaattatttattaatttacaagacaggttttaactcagccgaggtgggaaatggtgtccctgtccctcccaaagcacagagcacagaaatgaggccgtttacatggcgagtctccgtgctggtgtttaagtcattaaaaagatactcaaag

SEQ ID NO: 305978 - DNA, 2665 bp, Homo sapiens
  misc_feature (8)..(8): n is a, c, g, or t
ggaacggngccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcaccccttgtccacagcctaagatggcggcgagggggacggtgaaggttgcctcccgcccgtccgggctctgatcctccgtctccccgtcccccggcggccggcccatggcctggcggaggcccgaaccatggacctccgcaccgccgtgtacaacgccgcccgtgatggcaagctgcagctgctccagaagctgctcagcggccggagccgggaggaactggacgagctgacgggcgaggtggccggcgggggaacgccgctactcatcgccgcccgctacggccacctggacgtggtggagtacctggtggaccggtgcggcgcgagcgtggaggccggtggctcggtgcacttcgatggcgagaccatcgagggcgcgccgccgctgtgggccgcctccgcagccggccacctggacgtggtgcggagcctgctgcgccgcggggcctcggtgaaccgcaccacgcgcaccaactccacgcctctccgcgccgcctgcttcgacggccacctggaggtggtgcgctacctggtcggcgagcaccaggccgacctggaggtggccaaccggcacggccacacgtgcctcatgatctcgtgctacaagggccaccgtgagatcgcccgctacctgctggagcagggcgcccaggtgaaccggcgcagcgccaagggcaacacggccctgcatgactgcgccgagtccggcagcctggagatcctgcagctgctgctggggtgcaaggcccgcatggaacgtgacggctacggcatgaccccgctgctcgcggccagcgtgacgggccacaccaacatcgtggagtacctcatccaggagcagcccggccaggagcaggtcgcagggggagaggctcagcctgggctgccccaagaagacccctccaccagccaggggtgtgcgcagcctcagggggctccgtgctgcagctcctccccagaggaaccactgaacggggaatcttacgaaagctgctgtcccaccagccgggaagctgccgtggaagccttggaattgctgggagctacgtatgtggataagaaacgagatctgcttggggcccttaaacactggaggcgggccatggagctgcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccgggccgccaaaggcagcctgggcacccagatcggctttgcagacctcatgggggttctcaccaaaggggtccgggaagtggaacgggccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcacccctctgcacatggctgtggacaaggacaccacaaacgtgggccgctatcccgtgggcagattcccctccctgcacgtggtcaaagtgctgctcgactgcggggccgacccggacagcagggattttgacaacaacaccccgctacacatagcagcccagaacaactgcccggccatcatgaatgccctgatcgaagcaggggcccacatggacgccaccaatgccttcaagaagacggcctacgagctgctggacgagaagctgctggccaggggtaccatgcagcccttcaactacgtgaccctgcagtgccttgcggcccgggccctggataagaacaagatcccttacaagggcttcatcccggaagatctggaggcgttcatcgaactgcactgacctgcccagaacgcctgcaccctcacctctcccctctcctgctgagatgggggaaatccggctgcggcatagcagatgctcgttcttgcctccttcaggcaccaatcaggagaagggttctgcctcccatcccctctacctgcagacagggtcggaggtgttagcgagcctttggtgctagaagcctgcggggtcatgtgctaagaggacagtctttctccgggagcccgctcactcattctgagttaggaaaagacacaagaccttccccacatcctgtcggggctgtcagggctagtcgggggctgtcgggctagtcggggctgtcaaagctagatcggg

SEQ ID NO: 305979 - DNA, 2020 bp, Homo sapiens
  misc_feature (8)..(8): n is a, c, g, or t
ggaacggngccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcaccccttgtccacagcctaagatggcggcgagggggacggtgaaggttgcctcccgcccgtccgggctctgatcctccgtctccccgtcccccggcggccggcccatggcctggcggaggcccgaaccatggacctccgcaccgccgtgtacaacgccgcccgtgatggcaagctgcagctgctccagaagctgctcagcggccggagccgggaggaactggacgagctgacgggcgaggtggccggcgggggaacgccgctactcatcgccgcccgctacggccacctggacgtggtggagtacctggtggaccggtgcggcgcgagcgtggaggccggtggctcggtgcacttcgatggcgagaccatcgagggcgcgccgccgctgtgggccgcctccgcagccggccacctggacgtggtgcggagcctgctgcgccgcggggcctcggtgaaccgcaccacgcgcaccaactccacgcctctccgcgccgcctgcttcgacggccacctggaggtggtgcgctacctggtcggcgagcaccaggccgacctggaggtggccaaccggcacggccacacgtgcctcatgatctcgtgctacaagggccaccgtgagatcgcccgctacctgctggagcagggcgcccaggtgaaccggcgcagcgccaagggcaacacggccctgcatgactgcgccgagtccggcagcctggagatcctgcagctgctgctggggtgcaaggcccgcatggaacgtgacggctacggcatgaccccgctgctcgcggccagcgtgacgggccacaccaacatcgtggagtacctcatccaggagcagcccggccaggagcaggtcgcagggggagaggctcagcctgggctgccccaagaagacccctccaccagccaggggtgtgcgcagcctcagggggctccgtgctgcagctcctccccagaggaaccactgaacggggaatcttacgaaagctgctgtcccaccagccgggaagctgccgtggaagccttggaattgctgggagctacgtatgtggataagaaacgagatctgcttggggcccttaaacactggaggcgggccatggagctgcgtcaccaggggggcgagtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgccgtgtacgccgactcgggcaatttcgagcgctgcatccgcttgtggaagtacgccctggacatgcaacagagcaacctggagcctctgagccccatgaccgccagcagcttcctctccttcgcggaactcttctcctacgtgcttcaggaccgggccgccaaaggcagcctgggcacccagatcggctttgcagacctcatgggggttctcaccaaaggggtccgggaagtggaacgggccctgcagctgcccagggagcccggagactcagcccagttcaccaaggcgctggccatcatcctccacctgctctacctgctggagaaagtggagtgcacccccagccaggagcacctgaagcaccagaccgtctaccgcctgctcaagtgcgcgcccaggggcaagaacggcttcaccctccctgtccctcccaaagcacagagcacagaaatgaggccgtttacatggcgagtctccgtgctggtgtttaagtcattaaaaagatactcaaag

SEQ ID NO: 305980 - DNA, 2259 bp, Homo sapiens
  misc_feature (738)..(738): n is a, c, g, or t
  misc_feature (771)..(772): n is a, c, g, or t
agcactttgtgagtatggggtgaatcggcgtcggccttccactgtggggttaaatctcatcccgcggctctcctcctgtcggtcctgcagttcttttgtccccgggtagagggatcttctgcagaaatagcgctggaagctagagtgaggcctgagtactgccttggcctaggatggctagagaattaagtgaaagcacagccctggatgcccagtctacagaagaccagatggagcttctggtcataaaggtggaggaagaagaagccggttttcccagtagcccagatctgggttctgagggctcccgcgagcgcttccgaggcttccgctacccggaggctgcaggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccntgcttgcccatggaggatgctgcagagaagatnnagtggtagcttctaggcttactccagagtcccaggggttgttgaaagtggaagatgtggccctgaccctcacccctgaatggacacagcaggattcatctcaggggaatctctgtagagatgaaaagcaggagaaccatggcagcctggtctccctgggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgtaccagtga

SEQ ID NO: 305981 - DNA, 2632 bp, Homo sapiens
  misc_feature (738)..(738): n is a, c, g, or t
  misc_feature (771)..(772): n is a, c, g, or t
agcactttgtgagtatggggtgaatcggcgtcggccttccactgtggggttaaatctcatcccgcggctctcctcctgtcggtcctgcagttcttttgtccccgggtagagggatcttctgcagaaatagcgctggaagctagagtgaggcctgagtactgccttggcctaggatggctagagaattaagtgaaagcacagccctggatgcccagtctacagaagaccagatggagcttctggtcataaaggtggaggaagaagaagccggttttcccagtagcccagatctgggttctgagggctcccgcgagcgcttccgaggcttccgctacccggaggctgcaggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccntgcttgcccatggaggatgctgcagagaagatnnagtggtagcttctaggcttactccagagtcccaggggttgttgaaagtggaagatgtggccctgaccctcacccctgaatggacacagcaggattcatctcaggggaatctctgtagagatgaaaagcaggagaaccatggcagcctggtctccctgggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgtaccagtgaaaaaaaaaaaaaaaaaaaaaaaaaaaaaaaaaggggggggcggcttaaaaattcccccgggggggccaaagtcgagccagcaccccgtactttctgtttgctaccaaaggggggccccctaatgggggagagggtgcgatgatcaaaaaaacgcaagagcgaaccagagggcgcccatgcttataaaacaccgcgtcgcgtgatgcggggggaaaaagctggcgctactcgtggggacctaccggtggagcagggaaccccccacatcttcggggggggggggacaccatacgtgggcacacaaacatcatctcaacggagattttaacgcgccccaggggtcaacactttgcaactctccacgtctcctgaa

SEQ ID NO: 305982 - DNA, 2090 bp, Homo sapiens
  misc_feature (738)..(738): n is a, c, g, or t
  misc_feature (771)..(772): n is a, c, g, or t
agcactttgtgagtatggggtgaatcggcgtcggccttccactgtggggttaaatctcatcccgcggctctcctcctgtcggtcctgcagttcttttgtccccgggtagagggatcttctgcagaaatagcgctggaagctagagtgaggcctgagtactgccttggcctaggatggctagagaattaagtgaaagcacagccctggatgcccagtctacagaagaccagatggagcttctggtcataaaggtggaggaagaagaagccggttttcccagtagcccagatctgggttctgagggctcccgcgagcgcttccgaggcttccgctacccggaggctgcaggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccntgcttgcccatggaggatgctgcagagaagatnnagtggtagcttctaggcttactccagagtcccaggggttgttgaaagtggaagatgtggccctgaccctcacccctgaatggacacagcaggattcatctcaggggaatctctgtagagatgaaaagcaggagaaccatggcagcctggtctccctgggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaaccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgtaccagtga

SEQ ID NO: 305983 - DNA, 1742 bp, Homo sapiens
acagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccaaaaaaacc

SEQ ID NO: 305984 - DNA, 1813 bp, Homo sapiens
acagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatggtgatcacatgggatatacatataaagtaatcgagcgaatactggagattggtgcatttcgaccgcatatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccaaaaaaacc

SEQ ID NO: 305985 - DNA, 1653 bp, Homo sapiens
acagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccaaaaaaacc

SEQ ID NO: 305986 - DNA, 1953 bp, Homo sapiens
cctcagtcttctgagtagctaggactacagatgagcaccatcacaactggctaatttttcaatttttttgtagagatggggtcttgctatgttgcccaggctggtctcaaactcctggcctcaaatgatcctcctacctccagttcccaacgtgctagaattaaaggcataaggcaccacttctaggcaaaaatattatttattaaatattatttaaaactcttcatgcacgggtaaaaagatccattcaaagtgcaaggtaaacaaacaggttttaatgtaaccaaatatgaaaggttcactgatgtgctttcagatttcacactgcaactaacttgagaaagtatcctgtgtcaaattttactgtagtatcaaagaagaatatccacagttgcctggaaggtcctttaaaatgcatcgtcctcctttttccaactttatgtcagtgtgagttcagattttcttcatgtatttcaaccaaaacaacagcatgcaaaagatgggctgcagaagcagttatgggaatccagcaatcttctgcaagtcattgaagagatttgcagatatataaaacaatgtcttaaaattttcttctactttttttgttttgaaacatatagttattttagtaacaagataggtatgttaatgtattacaggtttagtattgtcatttttaaatgaattaaaaaaatttaaattgttctcagttttaatttctcttatggtaaatatcaatagctattacccacatgaacaaaaactctgtaggggtcttgataatttttaagagtataaagggtactgagaccaaacaatttgggaatcactgtgctaaataaataactttatttagtcctcgtgaatagcctgttaggtaggcaatattattgtgtcgctttgcagatgacaaaactgaggcacgaagaggtatagtgacttgcccaaggtcacccaggaagtagaaaggctggagctggaattcgaacccatgtcactgtgctctcctgacttccttgtctcctatggtccttccccatccttccaggtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccaaaaaaacc

SEQ ID NO: 305987 - DNA, 1533 bp, Homo sapiens
acagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccaaaaaaacc

SEQ ID NO: 305988 - DNA, 1444 bp, Homo sapiens
acagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggaaaagccagagggggcagagaccactgctgctaccaccaacggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccaaaaaaacc

SEQ ID NO: 305989 - DNA, 1405 bp, Homo sapiens
acagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggagggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccgggcagtctcagtgacccgtccaaagaagtggaatacgtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccaaaaaaacc

SEQ ID NO: 305990 - DNA, 1072 bp, Homo sapiens
acagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacaagccagtcccactcgtgtgataacccattaatctattaagccataagtggattaatccattcctgaggacctgagccctcacgacccaatcatctcttaaaggccccacctctcaatactgccatgcagaggattatgtttcaacctgagtgtttggaggggatgttcaacccataggaagtggcagtgtggaagaagtgctgctgaggagtgagtcactgggggccattttga

SEQ ID NO: 305991 - DNA, 1136 bp, Homo sapiens
acagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactgggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttggtcagcttctgtgcccaacttgcagcaagtccaaacgctcctgaagggctgcccacccacagccagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattccaaaaaaacc

SEQ ID NO: 305992 - DNA, 552 bp, Homo sapiens
ctgcggccccggtgctccggctgcgatgaggtgggagatagccgcgagatgggttagggggcttgagggacactgctgagggtaaaagcccagaggccaagaggagcatggctttgtggatgatgtgttctacagattgggaaactgaagtcaggcctcactgcatgctctcaaccttcattttctcatctgcaaaatgaggcagacaaccatgggattgttgggaggggtcagacacagtgccggtgaatcttgtccttggcataatgcctagcacttagtaagtactcagaacatagcaggatgaaccaggaggcattgcccacgttcaaacctgtatctgcatctcttattattattatcatgtggttacctaactccggagcctcagctgagtctcagttttactacttataaaatagggatgagaccagcgcccatcccatagagtggctatgaggatagatgagataatgcatgaaaatgcttgccacagggcctgacctaggaacttataaatggtagctgctgttagtcttacgataatatact

SEQ ID NO: 305993 - DNA, 674 bp, Homo sapiens
ataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttttgacccactactaacgattctccacccagcagacaaagtgatctcttaaaaatatctgttggcccaaagtgctgggattacaggtgtgaaccaccacacctggccaacaatatttgttttaattagccaggcgtggtagcatttgtcctagcaatttgggaggttgaggtgggagaatcacttcagcccactaggtcgaggctgtagtgagctataattgtaccactgcactccagcctcggggacagagtgagaccctgtctgcaaataaacaaataaaacatcaggctgggcttgagcatctattcctgctcaaaatttcgcaggcttctcagaagaaaatccaaaccccttacagtgacccagtttgcccttgaggcctccacccacacccccttccccccagtcttagggggtggcctggctgttcccttcaacggcaacgctctgcctccattgttggcctcctctgcagggagggactgt

SEQ ID NO: 305994 - DNA, 2586 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 305995 - DNA, 2639 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccccaaagtgctgggattacaggtgtgaaccaccacacctggccaacaatatttgttttaattagccaggcgtggtagcatttgtcctagcaatttgggaggttgaggtgggagaatcacttcagcccactaggtcgaggctgtagtgagctataattgtaccactgcactccagcctcggggacagagtgagaccctgtctgcaaataaacaaataaaacatcaggctgggcttgagcatctattcctgctcaaaatttcgcaggcttctcagaagaaaatccaaaccccttacagtgacccagtttgcccttgaggcctccacccacacccccttccccccagtcttagggggtggcctggctgttcccttcaacggcaacgctctgcctccattgttggcctcctctgcagggagggactgt

SEQ ID NO: 305996 - DNA, 2196 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccgggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 305997 - DNA, 2433 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccgacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 305998 - DNA, 2568 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcacttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 305999 - DNA, 2481 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcaggacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 306000 - DNA, 2388 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 306001 - DNA, 2151 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 306002 - DNA, 2379 bp, Homo sapiens
  misc_feature (96)..(96): n is a, c, g, or t
tgagagcggaagagacttcttctccagtcatcggggagctgtggtccccagaccagacggctgaggcctctcacgtcagccgctatggaggcagcnccagagacccggtactgaccctgagagccttcgcagggcccctgagtccagccaaggtgagctgctgtagaagcttctggaagtggtgcctggctgtccctatactgtgcggctgcggttcacagacttctacgtgcctgtgtctctgtgcacaccctctaggtaaagagggggccgcgcctcttccccgccccgaccctccatccctttcctcccaatggattgcaggggggcgggaaaaacgtctgtctctctctctagggaaggccacatttctgtctgtctcagggactctgtgacttgtcccgcagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 306003 - DNA, 2298 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagtccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 306004 - DNA, 2560 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 306005 - DNA, 1419 bp, Homo sapiens
aggtgtggggccactggtcaccctcggtggctcagaggctgtggctccatggctcatgagcgcctcctgtgtcccagacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcccaaaaatactatccctgagggggggccccaataagatagccaactaacgcccactattatgtaaaaaaaggagggccccccaaaaggaggagcgtctattaaaaaaagaagaacgagaatgcggccgctaatataaaaaacactgctgagtggagaggagaaaaaactatcgcgactgggattctttggaaagaacacaccctacttgagccggcggggagcacaaaaatgggggaacactcatcctctccagcgaataaattataaccccactgtgcgggagcataaaaattattatacttttgtgtaagttgtattctgcagggttaaacaagcgacggcgcctcatagtgtttcggtcgacaaaaacatttgcttctcggcgcatatttttttcttcgcagaaatatttttaacgcggcacaatgaatatataccccccatactctcatcc

SEQ ID NO: 306006 - DNA, 1372 bp, Homo sapiens
ggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcacgtaagtgatcttggcccaaccccctggctgcccgtgacccctacccagtgctaactccagtctttgcccccagcacacccactaccctcagttcagtgggcagagctttgcagagcgttcaggccgcgggccatttggggactccctgatggagctggatgcagctgtggggaccctgatgacagccataggggaccggagcagccgcctcgagacatacgcatggtctcaggtccattgtctgcagtgaagatgaccagcgactcttcaagcagccacccctgtggctctttgccta

SEQ ID NO: 306007 - DNA, 416 bp, Homo sapiens
ccctggccccaccaccccaaccttgatggcgaactgagtgactgaccagcctcctgcccccaggcgtgacccacgagctggccagctccctggacctgctgcctaccctggcagccctggctggggccccactgcccaatgtcaccttggatggctttgacctcagccccctgctgctgggcacaggcaaggtagggccggtgacccctgatcccagatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcccaccagggctggcagctccaggtatgtgcagtacttgggcgcctgcc

SEQ ID NO: 306008 - DNA, 699 bp, Homo sapiens
gaaaaagaaaaagcagaaagagaagtgattgtgagagaatttcaagaagaactggtcgatcaccttaaaacattttcaatatcagagtctccactggaaggtacatcacattgtcatattaatttgaatgagacatggacttcaaagaagaaattatttcaagtagaaattcaacctgaagaaaaacatgaagaattcagaaaactttttgaattaatatcattactgaactatactgcggaccaaataagaaagaaaaatcgtgaattagaagaagaggcaactggatataagaaatgcctagaaatgacaataaatatgttaaatgcatttgcaaatgaggacttcagttgccatggagacttaaatacagaccaactgaaaatggatattctgtttaagaagctaaaacagaagtttaatgatcttgtggccgagaaggaagctgtgtcttcagaatgtgtcaatttggccaaagacaatgaagttcttcatcaggagttattatctatgagaaatgtacaagagaaatgtgaaaaacttgagaaggataaaaagatgttggaagaagaagtattaaatcttaagacacatatggaaaaagatatggtagaacttggtaaactacaagaatataaatcggagctggatgaaagggcagtgcaggaaatagaaaaattagaagaaatccatttacag

SEQ ID NO: 306009 - DNA, 1193 bp, Homo sapiens
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaa

SEQ ID NO: 306010 - DNA, 824 bp, Homo sapiens
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggtcgtgtgcgtgaatttctccttagagggaaacaactgaccctgggtatagcaatcaagaatgaatggcattggtagaacatggtagggacactcaggcaacttttggcatcaggaacgcgtttggcgagatcgttggttttgatttgtagatcttcccctggagagttggagtaccaaagaaattgtagtcaataccagaagatgagtttttgggttgcggtcttgggaaagattgtgaaaagctgggttagtgaaactcgtgattgcatccctttaatcaaggaaggaaggtagactggaacaatgggagtggaatgcgtctttgcaggaaatagatccagggtaggtttggtagacacgaaatcgtgtgttgatgacagactggtttggctggagtcgaaagattgacacttgagtgacgccctttcaggaaactagagtgaaactttgtgaagtgaagaaagcatatgaggagaatacataaaaatctattgagggaagttgagaaaatgggaaggttcctaaataaaatttaggttttgaaaa

SEQ ID NO: 306011 - DNA, 351 bp, Homo sapiens
taaggaaaactcaagaatgtagcccctccagtataaaatatatactaaatcttcattataggggattcagtgtttggcttattctgtttactggagggtttagttataacttcttagagatttttggttttgtcttgttttatttaggaagcgttgggagatgttgtttattgtagtctccctgaagttgggacaaaattgaacaaacaaggtgagtgttcttaggatcttagaatgatccatgccatgaattttgtttacattgaatagtaatttgtttgtaccctggattaattagagtgcttttttttttttggagacagtctgggcaacagagcaagactccgtttt

SEQ ID NO: 306012 - DNA, 1579 bp, Homo sapiens
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctcagataatgga

SEQ ID NO: 306013 - DNA, 1348 bp, Homo sapiens
  misc_feature (1197)..(1197): n is a, c, g, or t
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaaaaanaaacaacaaaaaaaccaacacgaaaatcaaccaacaaaacacaaaccacacaaacagaggccaatcatcaccatgagaacccaccacacaagagtacaacactaaaaaacacactccaaaaaaacccatcacaaccccaaacaaacaaaca

SEQ ID NO: 306014 - DNA, 1692 bp, Homo sapiens
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcgggttaaactcatttcttatatgagccatctttatgctgcctccctaaacctcatcaccccaaattttgtcttcagaggcacagatttttttttctgcaagacagaccagtaatatgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctcagataatgga

SEQ ID NO: 306015 - DNA, 1373 bp, Homo sapiens
tgcaagcttggggtggatgtggcggccagatcccgttatctggctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctcagataatgga

SEQ ID NO: 306016 - DNA, 1435 bp, Homo sapiens
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctcagataatgga

SEQ ID NO: 306017 - DNA, 1309 bp, Homo sapiens
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttttgttttgttttgttttgttttgttttgtttgagatggagtttcgctcttcttgtccaagctggagtgcaatggcacaatcttgggctcactgcaacctccgcctcccgggttcaagtgattcttctgcctcagccccctgagtagctggggttacagcacaggaaaaagaagataaagtaggagagggatcagtttcacattcagtcctaagcagcaacacggttgagatgtaatcataaaagcaaatatttcacccaggacatggaaaagcggcggatcaccagaaagcagagagtcaaacgctgcaagcagaagcagtaagaagacgccacgtttggagcaaggtcttatttacacctgccatggtcatcggctcgctcttttaggtctccccaacccggcccccaaaaagaggttatatgcagaggtaatataatatatgtacttttgaaaataacaaagtcaccgtggagataatttcaaaacaatttattttcattttcagatacattggactatttcactgatgttaaaaagagtatgacttgtttaaattttttgttgtttcttttttgcagcctaatgttctgtaatagtaacttgcttccaagtaaagtatgaaaagttagtggaggggccatggctgtggtctctgataggtcaaactatactattttggaatgcgtggagttagaacaaagtttttattttgttattaattagtaaagcaataaataaaattgtcttacta

SEQ ID NO: 306018 - DNA, 1432 bp, Homo sapiens
aacccgcagctgcgtccatcagcatctccacactatctctttcgaccacctttgctatgtagatactcgtgctatgcagtcagtaagaaacactttctataactatctacctatatgctttagtcgtctgctggttggcaccccgagtgggcaacaacatcgcgcaggatcccctagagtcaagtagcaggacctgcaaatttggcattgaccatattttcaaatgttgtcttcaggctcactgatcattacttctatagctactgctctgatattaaccccatctattaaaaatttaaggtacctgatgggacgaagactggcccatcagcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctcagataatgga

SEQ ID NO: 306019 - DNA, 790 bp, Homo sapiens
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggaagttgtcttaaattagtggtggatagaagacttagaatagaaacttttagtattaccgatggggaaaaaaaaactactgttaacactggtggtgagagtgcgctgagggtgtgaggatgtagatgatgtgggggtcgtggggg

SEQ ID NO: 306020 - DNA, 1383 bp, Homo sapiens
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctcagataatgga

SEQ ID NO: 306021 - DNA, 1256 bp, Homo sapiens
taattatactagacgttctggtatgattcattcatcctgatgggagcaagatcgtcttctcccatcagtcattgtgtgacactcattactgctgttttgataaccaacaagaggtaatgtataaaatccgctgatgggccatcttctcccatcagcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctcagataatgga

SEQ ID NO: 306022 - DNA, 1238 bp, Homo sapiens
caaaggagcacttctctaatcatgccctcccgaagactggctgggagaaggtttaaaaacaaaaaatccaggagtaagagccttaggtcagtttgaaattggagacaaactgtctgatgggagcaaatgcccatcagcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaatcatgtttgttttgatgttaatatttcatttagtaactctgctagtatttgtgaaagtgctaactttaacttacggaaagttactttttaaaaggaaatttaagccagaacaatgcaaagctccaagaaaatgttttctttagtcacaaatctggtttttcttaagccaagatctgtcacctttaacataataaaaaataaatcaccaactttgattttctatcatgcgaggtctgaagaaagaagaggaaagacagaggaaggtggaagttttgatcagtatagcacatggtgtttttaagttgttaaaccacgttcaggtttccacttaagtcatgggaataaaagtggacaaggactgaagctttatgagctcagataatgga

SEQ ID NO: 306023 - DNA, 614 bp, Homo sapiens
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggtaagctgttgctagaaatttctcaaggaattactactacagtaaatattttatctagaat

SEQ ID NO: 306024 - DNA, 431 bp, Homo sapiens
  misc_feature (366)..(366): n is a, c, g, or t
cgcccccgcggcaccgcctccgcgcctccatccagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgttacccgccgcgccctgcccgccgaggccctggcagctgggggtgggcgccgtccgtacgctgcgcactggacccgctctgctctcggtgcgtaaattcacagagaaacacgaatgggtaacaacagaaaatggcattggaacagtgggaatcagcaattttgcacagaagcgatgntagatgttgtttattgtagcctccctgacgttgggactgaactctattcttctttatcagggggg

SEQ ID NO: 306025 - DNA, 329 bp, Homo sapiens
gtctctgataggtcaaactatactattttggaatgcgtggagttagaacaaagtttttattttgttattaattagtaaagcaataaataaaattgtcttactaatatttatgagtttttgttttgttatttattagtaaggcagtaaaacatttagtgttttttctggagtttgttgaagaaactgaatattgatagtgttccagctatggcatagccagtgctgcttttactgattcatatagcttgggccttgctcctttcaagcaagctgatttttaaatgcagtgcccctgtgaacgtcaagaacaccgacaacctgagagccgt

SEQ ID NO: 306026 - DNA, 2765 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 306027 - DNA, 1725 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggttggcttttacaaacccctaagcttcttctttacctttccttaaaatttcaaccttctcttttcttactctataattgagaatgataacacagagagttaataacagtcaccctgctaactttccttagcatgagtgaacagtgagagataaaaatgaaatcttggttaaccttgccaaatctccaggacaccgaagagttaaaaagagagaaaaacaaaaagattaagctctttttcaaaaaaacaaaaccacttaatttttttctacctaaaaccataacaagaaaaaatgctaacacttatttatttgaatggcacatggagaccgggcatgtggctcacacttgtaatcccagcaccttggaaggcggaggcgggtggatcacctgaagtcaggagttcaagaccagcctggccaacatggtgaagtcccgtccctactaaaaatacaaaaattagccaggtgtggtggtgcgcacctgtaatcccagctactcaggaggctgaggcaggagaatcacttgaatccgggaggtggaggttgcagtgagaggagattgagccattgcactccagcctgggcaacagagtgagactccatctcgaaaaacaaacaaacaaacaaaaaacagaatggcacattgatgagcattcattgattgattctttagtttttttatgttctctaaagaatttttaagatttaaagaagcatgtgctatttatttgtaggaaatcctcagaaaaggtacaaataaaaaataaaaattatccataattaataccagagattataattgttaattattatggtgttttctttgctagtatttaagatcattattaagatcacatacacatttttgcttactatcattagcatttgatgatatgatttttttaatttttatacattgttttaatggctgcacgatatttcattgtgtacaaataaaataactactgttccgctttgacctagcc

SEQ ID NO: 306028 - DNA, 381 bp, Homo sapiens
atgggtggaagtattttggtgcaggggagagggccgcgctgttaaagaaacttatattttatggggcgctttattgggggactgaaagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 306029 - DNA, 431 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacccagggtccagaccactgaagcagtgtgcagattcgcgagaggaagagagctgagccgctgtaaccctgggcctgggattgcggggacgggacgggtgggaagcggccaaaggcgcagcggcttctggtcagagccgcagaggcctgagacgtgggccgcgcc

SEQ ID NO: 306030 - DNA, 2801 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagcaactactctaaaatcttatgattcaaacaccccaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 306031 - DNA, 2931 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaaaaaaaaaacagataaaaccaaaaaaaaagaagggggcggaaaaaccaggggcacgagggcccccttttgaaaggcccagggcttaaaacagcgggtacaacggggaacagacggccgagaccctcgggatcgaacaaaaacagatacgtgtacgcgcctgctacaa

SEQ ID NO: 306032 - DNA, 2649 bp, Homo sapiens
gagaaatctgcgttttgattatgttcctggaaacaataactttctttcaagatctgaggaagaggaagactctctggaacagtggaaagaacttgtccttgtcctgggaatcaaaagatgtgaatcttgatttctactaaagatgaccctaggatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 306033 - DNA, 2711 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggtcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 306034 - DNA, 2711 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaactactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 306035 - DNA, 1606 bp, Homo sapiens
gtacatcataggtcgtggcacgcacaccaccagacttcaaaacccacccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 306036 - DNA, 1578 bp, Homo sapiens
atgagccggggaagggcactcctgtaagggggcacggaggtctgaagagcacggggagtatggccaactttcatggatttttagcacagctagaaggtaagtagagagagaggaagctggaggcacggccgcctgatcacaggagcccttccacacggtggcgctgctgggtcacccaagacctgagcaggtgtctccaggacgtgacatctctcccccgcgcccttaccacagtgttccagacatgctgactcattctctaaatagaagataagctgacccaaagactatgtattatttaatagaaaagattactgaaagcccagagggagccatatatcttctgtgacggctcccttcctcatttatttaatggcattataagcggcatgtcctctaggtggaagacataactaacatgctcttgcttctgttttaagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 306037 - DNA, 1234 bp, Homo sapiens
atgagccggggaagggcactcctgtaagggggcacggaggtctgaagagcacggggagtatggccaactttcatggatttttagcacagctagaagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaa

SEQ ID NO: 306038 - DNA, 1908 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttccggccagctggttctgaaccttacttttcagtggcattgatgtgaaattgcctgaatggttattccttttttcctgattattggtct

SEQ ID NO: 306039 - DNA, 2037 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaagtaagtttttggttcctacgctttatatcactatagtgtattgtcaaaagtgaatatatctctgtgtaaataggcatttttcccttttttgcttttaaacattttgtgtaggggaggaaaatattacattgaatggtgaataccaaactggcctgttaatcttgttgtggtttgtttttaatcctaaaagatgctaccagatctcagtaactttacaaaattatgtcaacttaattttaacatgatagtctcaaattatagtaagcaggcacatttcttgcatgaacaagagtaaataaatgtactttcataagac

SEQ ID NO: 306040 - DNA, 1236 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttagacttgtgaacaaatctgaaa

SEQ ID NO: 306041 - DNA, 1989 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggtaaggtttcgcagtgatctttgagggaggctccttaatggctaacaaaatattcacgcaggtcatattattaaatccctccttaaggggatattgtaaggactctgcggtgattccattttctacctgttgattttttaaagcaaagttatcaccattttacacctatagaacacagaagaaggaagaatgtatgtaaagtcactttgcaaatagaattcagtgacttgtagaaagttctttgaccctcctcatttgcactggtccctgctatgtgtacacactctcccctcttctaacctgtcacatttttgtttatctcccattttttatggctatgagaaggcacactggctccttatacgatcaggtcatttctatgttccttcctctcccccactaatttctttccctaccctgcccacacctacccagtgtccatgaaaacacagctgtacttgaaagcaatttccaaatggtccaagaaagaatgtagcttgagagtatgtctgggttagcaagctgcagtgactcctgacattaaaattgtgctgcatcgtatgtttattgcggcactattcacaatagcaaagacttggaatgaacccaaatgtccatcaatgatagactggattaagaaaatgtggcacatatacaccatagaatactatgcagtcataaaaaaggatgagttcatgtcctttgtaggaacatggatgaagctggaaaccatcattctgagcaaactatcacaaggacagaaaaccaaacgc

SEQ ID NO: 306042 - DNA, 1592 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccgtatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggttggcttttacaaacccctaagcttcttctttacctttccttaaaatttcaaccttctcttttcttactctataattgagaatgataacacagagagttaataacagtcaccctgctaactttccttagcatgagtgaacagtgagagataaaaatgaaatcttggttaaccttgccaaatctccaggacaccgaagagttaaaaagagagaaaaacaaaaagattaagctctttttcaaaaaaacaaaaccacttaatttttttctacctaaaaccataacaagaaaaaatgctaacacttatttatttgaatggcacatggagaccgggcatgtggctcacacttgtaatcccagcaccttggaaggcggaggcgggtggatcacctgaagtcaggagttcaagaccagcctggccaacatggtgaagtcccgtccctactaaaaatacaaaaattagccaggtgtggtggtgcgcacctgtaatcccagctactcaggaggctgaggcaggagaatcacttgaatccgggaggtggaggttgcagtgagaggagattgagccattgcactccagcctgggcaacagagtgagactccatctcgaaaaacaaacaaacaaacaaaaaacagaatggcacattgatgagcattcattgattgattctttagtttttttatgttctctaaagaatttttaagatttaaagaagcatgtgctatttatttgtaggaaatcctcagaaaggtccactaccaataaaatttcctattataccagagttttatgtcaatatatgggttcttgcagtattagatcttattagatccctacccttttgttcttcctag

SEQ ID NO: 306043 - DNA, 477 bp, Homo sapiens
ttgtaagaggttgaacttgagagaccagatcaggcagtgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgtgagtaacccttaatttctatgtttaacccattctctggccattggctgaaatgatggctaataatatcctctgaactagaggttggactgaagttcttcaggaagctttcatctctggctcactcatctcttcttctgcaaactgttgggaaggctgaaactacagcaaaatgcctccagctccattctttgctttcggctcatgga

SEQ ID NO: 306044 - DNA, 458 bp, Homo sapiens
gctgagtgacactcttgtgtatatttccaaatttttgtacagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaagaccttggtattgtaattatttttctgattcatcatttgcttttcaatttcacttacagttgtttcttttttttagatgagggtctccctatattgtccaagctggtctcagactcctggcctcaaaggatcctcctgcctcagcatcccaaagcgctgggattacaggagtaagccactgtacccagcctcaatttcatttatagtttttgacaagtaaaaagttgtttaacaatgt

SEQ ID NO: 306045 - DNA, 383 bp, Homo sapiens
ttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgc

SEQ ID NO: 306046 - DNA, 1777 bp, Homo sapiens
tacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatatctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaatta

SEQ ID NO: 306047 - DNA, 992 bp, Homo sapiens
tacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagaggtaagtttagaaattttattactatgtcaatacttggactga

SEQ ID NO: 306048 - DNA, 1873 bp, Homo sapiens
tacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatatctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaataagactggcacttaccctgaagtgcattaataaaaccacactttaaaattaaaaatcatccacaaccacaaaacagaaaataaaaaaaggcagccatactcagggggatgaacaccctcaacggcgtatgtaatcaaaagcggcaaa

SEQ ID NO: 306049 - DNA, 1835 bp, Homo sapiens
  misc_feature (1551)..(1551): n is a, c, g, or t
tacagctttgattttataacatcctgctaatttttgttcttacagaaatacactttcgggaaatggcctctaaatcctggctgaattttttaaccttcctctgtggatcagcaataggatttcttttatgttctcagctatttagtattttgttgggagaaaaggttgacacccagcctaatgttcttcataatgatcctcatgcaaggcattcagatgataatggacagaatcatctagaaggacaaatgaacttcaatgcagattctagccaacataaagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatatctatatatatgaggaacttgtgttttttaaatggtggccaggtagaggaactagaaaagagattttgttgcctcacttgcgacacactgtataaacttcactgacctactatattaggacataaactcaaactacattgcaaaacgaaaccattaatcatatgtgatttaattaatagacccttntaagaaattcctctcaatacttatttgaagatctgtagctgataacaacaagtccacatactcaccttgtatctccaacacctccccaacttctttcacactcggacctctctttttccttcccacacccaccacgacccaactcaaaacccctctccttcacttctacacccaccctctcatgtaacactcaccacccccctcctccctctttcccctacaattaatctttcctttccaactcctctcccctctttattcaaccctcctccataccaccaacc

SEQ ID NO: 306050 - DNA, 766 bp, Homo sapiens
aatctcaggtcactgcaaccctgcctcccaggttcaagcaattctcctgcctcagcctccaagtagctgggactacaggcacatgctaccactgccggctaattttttgtattttagtagagatggggttttaccatgttgcccaggctgatttcgaactcctgatctcaggcaatccgcctgcctctgcctgccaaagtgctgggattacaggcgtgagcgaccgtgcctggcccatattttcttttattgaagtatactttcctgtttctttgtgtaccttcttgtgattttttttgttgttgtttttgaaaactggacttttgaatagtatattgtggcaactctgaaaataagattcttctccttctttggggtttactgttttattttatttatttttttgtgtgtgtggttgtttttgttttcattgttgagacctgtaatagtcttgttctagtaacttttcctatttttgcagagacttttctttgtcatgtgtggttgctgaagtctctgtcccttagcttgtattcagtgagtggggtttttttgtttgtttgtttgtttttgagacagagtttttgctctgttgcccaggctggagtgaactggcctgatgtcagctcactgcaatctcccaggttcaagcaattctcctgcctcagcctcctgtgtagctaagattgcaggcacatgccaccacacccagctaaattttgtatttttagtagagatggggtttcaccatgttgtccgggctggc

SEQ ID NO: 306051 - DNA, 242 bp, Homo sapiens
ttttgattttgggtagaaacaggtgtcactatggtgcccaggctagtaactcctgtgctccagcaatcctcctgccttggcctcccaaactcctgggattacaggcctgagtcaccaagctcagcctctcctcatcaaaaccattccctctttgtaagattcttcctatgtcttaaaacttaatacctttaatccttccctggagccatagttttatttatttatttatttatttatgagac

SEQ ID NO: 306052 - DNA, 5184 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccactgtcttcgccttcttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 306053 - DNA, 4958 bp, Homo sapiens
tcagtctggtactcttttttgaatgttgtcaaaactagttaattggaagttaacggtactatttatactaaaagagtaccagactgtcttcgccttcttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 306054 - DNA, 469 bp, Homo sapiens
aataaaatatgcctcatttgccttggaaattttgtggatgaatgaatgacagtttattgtagtgtcctgctagttgaaaggtgacccttaaaattttgatggattttaacaacagattttatggtaatagtttttctattatttgtcacatttgacacttttaaaatttgtttaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctca

SEQ ID NO: 306055 - DNA, 5147 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccacggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 306056 - DNA, 5182 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccacggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttgaaaaaaaaaaaacgctaagcgacagagcgagaaag

SEQ ID NO: 306057 - DNA, 5497 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccacggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttgcctgctgagtcacgaccctgtctttgttaaagtccatcttgaaattcttatgcttcaggaaaggttttctcaccagtagggtgaggctggctttcctattcatgttcttccatttctatgccttttggatatgcaagtcacgtctccctaggtcttctgcagcccccaggagagagacttgaatctccatgcagccaggatgcggcatagtgtccttcacttgttcattatgattttgtttgtaattttaaatgttttaaacccaagattgggataatatgtgtgtaaaattaatagcatttcttttagaattagaaattgtaaatataccctttatgaggatggcatag

SEQ ID NO: 306058 - DNA, 4421 bp, Homo sapiens
ttctgttgagaattgtttgtgtcgcatttacagcgactgtgctgaagggaacaagtcatacttgtcctagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 306059 - DNA, 5367 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccactgtcttcgccttcttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagaggagacaataaccggaataatacgggatgctgtacgtgaaagggccagacccagtgcctgacacattgagtagcagtccaaaggaaaaaataaaaagaaaaacaaagtccataggtgaactttgtaggttacgtgaaacatttgttgatgaaactgttcaaaatatcaaagacaaaaagtaaatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 306060 - DNA, 5305 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccactgtcttcgccttcttgcacttcgcgggagaagttgttggcgcgaatggatcctgagcctcgataacagattcctcaaccggcccacccgccagccagccagcgccttcatcctggggctgcgatggtgaagtctcgctctgtcaccaggctggagtgcagtggcatgatctcggctcactgcagcctccacctcccgggttcaagcggttttcctgcctcagcttcccaagtagctgggactacaggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 306061 - DNA, 4160 bp, Homo sapiens
ttttttgcgaggtctcactttgtcacccacgctggagtgcagtggtgctatctcagctcactgcaaccttgacttcttgggcttgattgatcccctcaccgcagccccccaagtagctgggactacaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 306062 - DNA, 4207 bp, Homo sapiens
aataaaatatgcctcatttgccttggaaattttgtggatgaatgaatgacagtttattgtagtgtcctgctagttgaaaggtgacccttaaaattttgatggattttaacaacagattttatggtaatagtttttctattatttgtcacatttgacacttttaaaatttgtttaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 306063 - DNA, 4423 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccactgtcttcgccttcttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaagggtgctatgatgtctattgcatttaaagaaggtttaaagattccccctccagctatgaatgaaataattttgggagccaatcaagatatcagacaggttttacataatctgagtatgtggtgtgcacgaagtaaagcattaacctatgaccaggccaaagctgattctcacagagccaaaaaggatatcaaaatgggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggggtgacatgaaaaagcacctgatgcttttaagcagagcagcagacagcatatgcgatggtgacctagtggacagccagatccggagtaagcaaaactggagtcttctgcctgcgcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatg

SEQ ID NO: 306064 - DNA, 1964 bp, Homo sapiens
gaaagggtctgactgccctgtaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcagaacttactccagcaaaaggactgtaaacatggattatctgtcgcttctaagggatgcacttgtacagcccttgacctcacaaggagtagacggagtacaggatgttgttgcacttatggacacatattatttgatgaaagaagactttgagaatatcatggaaatcagcagctggggtggcaaacctagtcccttttcaaagctggatcccaaggtgaaagcagccttcacaagagcttacaataaggaagcccaccttactccatactcacttcaagctataaaggcatctagacacagcacaagcccatccctggattcggaatacaatgaagaattaaatgaagatgactctcaatctgatgagaaagaccaagatgctatagaaactgatgccatgatcaagaaaaagacaaaatcttcaaagccttcaaaaccagaaaaagataaggagcccagaaaaggaaaaggaaaaagttcgaagaaatgaaaccatttttcactagcgacagccactttttactctccctcctgaccagtccagctggtctagagaaagccttgttttttcccagagcaaccatgttttagcataatgggatgacctggtgtcccattataaataaagggtggtatggctagaagggtatgagcagtaggcttatgtacacctcttatagaggttgataggactgcttgggtcctccactgtcctctgtcaatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 306065 - DNA, 3811 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccactgtcttcgccttcttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatctagttagacgtgcttctgaatgactgtagaattggaactagaaactacacctgggctttggagtcagattttagttaacaataatgagcctgggagcagtagtactaaggcgtcttttgtaggcttaagaatttatcctaatggcctttataggaccaatgctgattttttttaaaggcagttcctattatgtggtgaaattttgtaaataaatgattatacaaaacagtcaccacctagaactgggtattctttgtacattgtcagatatctttcaaagtataaattaggaataaaaatgttccacatgatatgtgtacaaattctttttaagattgtcatcttgtacagcaaaatattatgttggtatattacttccttattaatttgcaaatgattggattaaaaaagctcactgtattccttactaacctgttgtgtgaaacataacattggcagtcgaggagtcagaactcggattcccagcctcactccctctgtgtgtgttgaccacgtctctgctgtgaataggatttcatgcagtggtctgttatggggctttgcagcgtggggggctgcagaagattctcagacattcttatccttctggagtctcaacccatcaggttcagaccagtaggaaccaggctgggtcaggctcttaatttcactacggtgggggacaaaatgaacactggcttttgttcactttgcccctgagagatctagtcctgtcctgtgatggcttccacaaaccctgttggaagtttgggttattcctataactgtatgtgttgagtggccgtgaggctatggacctagcctggaatttagatgtctagctattttttaatcttgttggtaaatgctcagaggtctgtgctacctctgtgaggtatatactaaaatgaatgtaaaataaggatcgtattccctgctttaaggaactggtagtcttgtttgggtgatgagacaaagttcttgagacatttaaactgtatttaccagtgtgaaaaatgtcatttatggagattaattcattatggaaataaaacattgcctaagcccttg

SEQ ID NO: 306066 - DNA, 2888 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccactgtcttcgccttcttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaagaaaatgccattaaattgaaaggagagacaaaaactcctaagaaaaccaaaagttctccagctaaaaaagagtctgtaagtcctgaagattctgaaaagaaacgcactaattatcaagcttatcgaagctacttaaatcgagaaggtcccaaggctctgggctccaaagaaataccaaagggagctgaaaattgcttggaaggccttatatttgtaatcacaggcgtgctggagtctattgaacgagatgaggccaagtctctaattgaacgttatgggggaaaagtaacaggaaatgtcagcaagaaaacaaattatcttgtcatgggtcgtgatagtggacagtccaagagtgataaggccgcagccttggggacaaaaattattgatgaagatggcctgttgaatctgattcggactatgccaggcaagaaatccaagtatgaaatagcagttgaaactgagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacgcagcaaagtttggtaaattttccggcaaagatgatggctctagttttaaagcagcgttgctgtcaggccctcctggtgttggcaaaaccaccacagcttccctggtgtgtcaggagttgggatacagctacgtggaactgaatgcaagtgacacccggagtaagagcagtttgaaggcgattgttgctgagtcactgaacaataccagcatcaaaggcttttattcaaatggagcagcctcttcagtaagcacgaaacatgctctcatcatggatgaagtagatggcatggcaggcaatgaggataggggaggaattcaggaattaattggcctgataaaacatactaaaattcccattatttgtatgtgcaatgatagaaatcatcccaagattcgctctctggttcattattgttttgatcttcgttttcaaagacctcgggttgaacagattaaggtgctatgatgtctatgctttaagacgttaagattccccccaggtataagaatatttgggccaccagaatccacggttcataacggatgggggcaaaagtacataacgcaagg

SEQ ID NO: 306067 - DNA, 1446 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccactgtcttcgccttcttgcacttcgcgggagaagttgttggcgcgaatggatcctgagcctcgataacagattcctcaaccggcccacccgccagccagccagcgccttcatcctggggctgcgatggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctca

SEQ ID NO: 306068 - DNA, 1567 bp, Homo sapiens
cctttccgtccttgcttcttttttcattgatgtaaatttttttaacttaatatgaaaactctccaagtcttgatcatcagccaggattttgccacagcaatttcattctcttatcggagcttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcggaattccactgtcttcgccttcttgcacttcgcgggagaagttgttggcgcgaatggatcctgagcctcgataacagattcctcaaccggcccacccgccagccagccagcgccttcatcctggggctgcgatggtgaagtctcgctctgtcaccaggctggagtgcagtggcatgatctcggctcactgcagcctccacctcccgggttcaagcggttttcctgcctcagcttcccaagtagctgggactacaggacattcggaaattctttggagtaataccaagtggaaagaaacttgtaagtgaaacagtaaagaagaatgagaaaacaaagtctgatgaagaaactttaaaagcaaagaaaggaataaaggaaatcaaggtaaatagctcccgtaaagaggatgacttcaaacaaaagcaaccaagcaagaaaaagaggatcatctatgattcagattcagagtcagaggagacgttgcaggtaaaaaatgccaaaaagccaccagaaaaactgccagtatcttctaaacctggtaaaatttcacggcaggatcctgttacatacatttcagaaacagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagagctttcacaaaatacagatgagtctggattaaatgatgaagccatcgccaagcaattacagcttgatgaagatgcggagctggagaggcagttgcatgaagatgaagagtttgccagaacattagccatgttggatgaagaacccaagaccaaaaaggctcgaaaggacacagaagcgggagaaacgttttcatctgtccaagccaatttaagtaaagcagaaaaacataaatatcctcataaagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctca

SEQ ID NO: 306069 - DNA, 168 bp, Homo sapiens
gtaggtgggattactctgtttcgggtattttatcgatttggtgtatttggcctttatccagtaatgatcatgtgagtcaaaagatttgtgttttagtttttattttattggtaactagatgaatgatcctggataagttccttatattttatgggcctgagttttatc

SEQ ID NO: 306070 - DNA, 397 bp, Homo sapiens
gtaagtgttctacatataagcaagtatgctcaggatttatacccattcactaatattaacaggagaaactaggatgtagtaaataggcaacatgttttaataattaaaataattttcctatgattatggataaaatgtattgccctcattttaaaggatgaggaagttggaatgttacatatttaattttttaattcttgaaagcgggaaaagatcatttaagccataagaaaaaatgataattattcgaatttaaattgagttctcagaatggaaactcattttactattgacctcaaccagtcaatattagcgataaatttgtttccaaatgagataataaatagattccttataaatagagcatacctatgctacacttgtgaccttctctact

SEQ ID NO: 306071 - DNA, 436 bp, Homo sapiens
ttgtttccatcttttagctataatgtggttatgaacatttgtgtacaagtttttgtcgaggcattaacttttaattaggaaactttgaaacaaaaatctcaacactgtaccttgtttttttcaaactaaaattggagtacttattacttttaaaaatcaacgtgttgtcacttttagaaattgcatttggtggtttctggtgtgtttgttaatttttatagtttagaaggtggtgatttccacaaacaggaaagtctgttgtgaaaagaccagcccaggttgagtagcccacttggatatctctgattgctctctgtagtacgtttagcaggatagaaattctgtatgtttcatcaggtttcttttttcctcatttttccacttcttaagatgaagaaagagtccaaactggagagaacaccccaaaaaaatgtcc

SEQ ID NO: 306072 - DNA, 706 bp, Homo sapiens
cccgttaaacatggatatatggatatatcatgaaatataatttaaaattcaggtgaattcctaaagtaaaacactttttgcatttctttgcttggagctggcaacttggcttattcccataatctgccctgaggtgtgtggctttagagagtggaaagttttgagaagcgctgatgcagggatgttcgtaagtcagttgtctgtaagttaggaagtacttgtgtagctaaaactgttaatttcacagccagacacagaagtgacacaataaaaataatgtttatttctagatatgtattttaaattttgcatgaattctgtatgactttgttcattttcctttccctgttcccaaagtctgtaagtcctgaagattctgaaaagaaacgcactaattatcaagcttatcgaagctacttaaatcgagaaggtcccaaggctctgggctccaaagaaataccaaaggtaagagtactgagagggcatgccattctgtgagggcctctgccgtatgggtccatgtatgtattcacgatgattatagcagcagaggattaataattaaaaatgagcaacagaaaagcttcagttactgtcttcaagaattagggatgtttattcatgttatgaatcactgcttgatacttagaaaaatttccctttaaataacaagtagccctagaaaggctgagctttgagactatac

SEQ ID NO: 306073 - DNA, 511 bp, Homo sapiens
gtagtctcagagttgactcatagttggccaggtcatcttcagctctcttgcttattgcctgtaggttttattcttcagtggttctgatagcaaatcatctgctagtctagatgatcttagtcctataagtaaatgtatttatagatttactataaacagatggtcttgacactttaggactttgggccttcagggtatattctgtgctaagattactcagttgaaaaatgaaagaaaagttgatatagattatcattttccaaaaacaacaaccataatcttttctttcttcctagtaaaaacagcacaagtttcagatgaaagaaagagctacagtcctaggaagcaaagtaaatatgaaagttcaaaagaatctcagcaacattccaagtcatcagctgacaaaataggagaagtctcttctcccaaggccagttctaagctggcaattatgaaaagaaaagaagagagctcttataaagaaatagagcctgtggcctcaaaaagaaaa

SEQ ID NO: 306074 - DNA, 2416 bp, Homo sapiens
cgatttcattcctcgctccccacaggtccctctccccaaaatattcccatcttgtcctagcccatcccccagactatctcaaggaccagctgtccccacgcccccgacctccactaggcctgtgccacccgctgcctgcaggaagacgcccggtcccgggccgggttagccccatgggaacgcagcgcctgtgtggccgcgggactcaaggctggcctggctcaagtgaacagcacgtccaggaggcgacctcgtccgcgggtttgcattctggggtggacgagctgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306075 - DNA, 2310 bp, Homo sapiens
cgatttcattcctcgctccccacaggtccctctccccaaaatattcccatcttgtcctagcccatcccccagactatctcaaggaccagctgtccccacgcccccgacctccactaggcctgtgccacccgctgcctgcaggaagacgcccggtcccgggccgggttagccccatgggaacggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306076 - DNA, 650 bp, Homo sapiens
ggcggggagcggggccgcggcgtggagagcgggcgggagccgcagccgcagcgaggccggcgggcgggagcgcacggaggtggggtcggccaggccggtgcgggctccttgcggcaggtcccaagagggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaa

SEQ ID NO: 306077 - DNA, 659 bp, Homo sapiens
ggcggaggacctccacggtgcacccagcttttcccagccaccttccagcggggccctcccccgcgtacccccatttggcagatgagaaaattgaggctcccagaggccaagtgattctcaaggtcacacgaggaagcggtagagccaggcggggacggctctgggtggctcttaggaaaagtccgcctgagaactccgtacaggagctcccctgtcctccagcctgggggagtgagtatgtgtagggccggggtacctttccgtggggcaaggctctgccaaaatctgggagtgaggggagtcagggactggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaa

SEQ ID NO: 306078 - DNA, 1030 bp, Homo sapiens
  misc_feature (899)..(899): n is a, c, g, or t
ggcggggagcggggccgcggcgtggagagcgggcgggagccgcagccgcagcgaggccggcgggcgggagcgcacggaggtggggtcggccaggccggtgcgggctccttgcggcaggtcccaagagggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggaggaagcntgctaacagctgcagaacatatccaacacgcgttgatgtgaagaaggggtcaggggggcctgtaaccacagatcacatatacccggacatcaagggagaaaccaacaagacaaggttagccctgagaaccc

SEQ ID NO: 306079 - DNA, 1098 bp, Homo sapiens
ggcggaggacctccacggtgcacccagcttttcccagccaccttccagcggggccctcccccgcgtacccccatttggcagatgagaaaattgaggctcccagaggccaagtgattctcaaggtcacacgaggaagcggtagagccaggcggggacggctctgggtggctcttaggaaaagtccgcctgagaactccgtacaggagctcccctgtcctccagcctgggggagtgagtatgtgtagggccggggtacctttccgtggggcaaggctctgccaaaatctgggagtgaggggagtcagggagctggggccgcagggcgggccctgcaccgcaaatgggaggggggcgacggaatgggcgtgcgcacccatgggggtgtgtgcatgtgtgtgggagtgtacatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggtttgcattctggggtggacgagctgggtatgtgtgcctgagggtttcttcgtgcaggtgtgcacagggtgtgggtgccattgtgtgtgagagacggaggatgggaggccggtgcctgtggcccggtgcgtgtaagtgcggacgcctgcacctccacttaggtccccggcctccgacgactaacttgggtgtggagtgtttgcccctgccaggtgcgtatgaccccgccagtgaccggagttgctaatggtgtcatgcacccaccggccacccttggcgcgagcgcccccctctggacaccctgctccgtgcgcgctcacagttcgcctgtgcggggccggggccagggtcaggagccggggatagggaggaagagggcctgtggacaagctgagccgggacccctgggacctttgcggaggtggcctgggagcgctcagttcccaggctgaggcttcccgctgacgcctcctggccgcagcgggctccccccgccccaggaatgttcctctcccatccagtccgcctcccctagggcaggccccctgggggctgccgcagccc

SEQ ID NO: 306080 - DNA, 379 bp, Homo sapiens
accaaagcagacatagagcagctcccgtcgtaccgctttaacccggacagccatcagtcggagcagacgctgtgtgtggtctgcttcagtgacttcgaggcgcggcagctgctccgagtcctcccctccacccattgagttcccccttttaaaaaatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306081 - DNA, 2166 bp, Homo sapiens
cgggtctgggagagggggcagcggccacgagagctaaggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306082 - DNA, 2151 bp, Homo sapiens
ccgctctgcctctcccgggacaggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306083 - DNA, 2254 bp, Homo sapiens
ggcggggagcggggccgcggcgtggagagcgggcgggagccgcagccgcagcgaggccggcgggcgggagcgcacggaggtggggtcggccaggccggtgcgggctccttgcggcaggtcccaagagggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306084 - DNA, 2196 bp, Homo sapiens
taagctgccgcagggaccgccgcgtgcggggcgagagggagcccccggtgggggtggcgcagccggcggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306085 - DNA, 2662 bp, Homo sapiens
ggcggaggacctccacggtgcacccagcttttcccagccaccttccagcggggccctcccccgcgtacccccatttggcagatgagaaaattgaggctcccagaggccaagtgattctcaaggtcacacgaggaagcggtagagccaggcggggacggctctgggtggctcttaggaaaagtccgcctgagaactccgtacaggagctcccctgtcctccagcctgggggagtgagtatgtgtagggccggggtacctttccgtggggcaaggctctgccaaaatctgggagtgaggggagtcagggagctggggccgcagggcgggccctgcaccgcaaatgggaggggggcgacggaatgggcgtgcgcacccatgggggtgtgtgcatgtgtgtgggagtgtacatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306086 - DNA, 1855 bp, Homo sapiens
tgggtggtgggagatgaggaggagttgctgggactgggaacattcgtgcctaggacagtgcctcgcattatgtaggttctcagtaagcgtgaatggtgtgtctgtgtgagtggggggccacgaggcatgcgcatgtccagcaaagggctcactacccctgcccccccagccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306087 - DNA, 1736 bp, Homo sapiens
ggtgtgaatcccatgtctccatcaagttgagtcacaacccccattccccaggaggacctgaaacataagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306088 - DNA, 1278 bp, Homo sapiens
gtgggggtatgactcctctgtcctttgtccccagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 306089 - DNA, 1887 bp, Homo sapiens
cgatttcattcctcgctccccacaggtccctctccccaaaatattcccatcttgtcctagcccatcccccagactatctcaaggaccagctgtccccacgcccccgacctccactaggcctgtgccacccgctgcctgcaggaagacgcccggtcccgggccgggttagccccatgggaacgcagcgcctgtgtggccgcgggactcaaggctggcctggctcaagtgaacagcacgtccaggaggcgacctcgtccgcgggtttgcattctggggtggacgagctgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaacagcccacgaggttgaccccaacaccccgggcccgggtactgacggagtggactcggtgcaaaccaagtggatcaggcctcgggggagcaatcgagaagaaggggagctcggaccgaattgcgtgatgggcaggcacatctctcatgaaatccgacctccgggaatgctactacgccttggacccacaccaacagaggttgcacacgaggaagagtcaaaccgcccaaccgtatgggcaggcacacaagatacacgccacaccaacaaacgagagaaaaggcacagcaggaaacgaacgaagcggaggagagacacaacaaacacacagaaactggatggagagtgatgac

SEQ ID NO: 306090 - DNA, 1058 bp, Homo sapiens
ggcggaggacctccacggtgcacccagcttttcccagccaccttccagcggggccctcccccgcgtacccccatttggcagatgagaaaattgaggctcccagaggccaagtgattctcaaggtcacacgaggaagcggtagagccaggcggggacggctctgggtggctcttaggaaaagtccgcctgagaactccgtacaggagctcccctgtcctccagcctgggggagtgagtatgtgtagggccggggtacctttccgtggggcaaggctctgccaaaatctgggagtgaggggagtcagggagctggggccgcagggcgggccctgcaccgcaaatgggaggggggcgacggaatgggcgtgcgcacccatgggggtgtgtgcatgtgtgtgggagtgtacatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaa

SEQ ID NO: 306091 - DNA, 981 bp, Homo sapiens
ggcggaggacctccacggtgcacccagcttttcccagccaccttccagcggggccctcccccgcgtacccccatttggcagatgagaaaattgaggctcccagaggccaagtgattctcaaggtcacacgaggaagcggtagagccaggcggggacggctctgggtggctcttaggaaaagtccgcctgagaactccgtacaggagctcccctgtcctccagcctgggggagtgagtatgtgtagggccggggtacctttccgtggggcaaggctctgccaaaatctgggagtgaggggagtcagggagctggggccgcagggcgggccctgcaccgcaaatgggaggggggcgacggaatgggcgtgcgcacccatgggggtgtgtgcatgtgtgtgggagtgtacatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgctggcggccttaaccctctccttcacctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaa

SEQ ID NO: 306092 - DNA, 1329 bp, Homo sapiens
ggcggaggacctccacggtgcacccagcttttcccagccaccttccagcggggccctcccccgcgtacccccatttggcagatgagaaaattgaggctcccagaggccaagtgattctcaaggtcacacgaggaagcggtagagccaggcggggacggctctgggtggctcttaggaaaagtccgcctgagaactccgtacaggagctcccctgtcctccagcctgggggagtgagtatgtgtagggccggggtacctttccgtggggcaaggctctgccaaaatctgggagtgaggggagtcagggagctggggccgcagggcgggccctgcaccgcaaatgggaggggggcgacggaatgggcgtgcgcacccatgggggtgtgtgcatgtgtgtgggagtgtacatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaaaaaaaaatataatgaaagttaaagcagtgttctagcacttggagcgacggatcggcccgtacagagccgagcgcgtacgggttggtctcgatagccgtcgatctcagggggcggcgtccccaatgacgtacgccctcggtttacgttgctttaacgagggggcctgtagctgtccgcggggctatcgcgaattcgtaccctttttccggcgggggtccagcgggatttccgcgtattagatggtccgctaggtggccgcttatctgaccct

SEQ ID NO: 306093 - DNA, 1188 bp, Homo sapiens
gtggctgtcttcgtggaagcaattcagtagcagagcttcccaaatcattcctcctgttcaggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatgaagttaatctctcacgtgactaagggctatattcaatgctagtgatttctttttttcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttttgtttttttaaaaatatttttatgtgttcaaactattttggtaaatttttagcaaaaaaa

SEQ ID NO: 306094 - DNA, 1156 bp, Homo sapiens
ggctagagtagggatgatgcataatctttcattgtttgttagaggggtgagtggagagtttaaaaatagcgtcccctccctcctcccctcccaatgctgatccctcatgagttatttctgttggccgcattaggaacctgacatttgattcattcagtgggtcctgcctaggtcctttaaaacagaatggactgttagggaaaggctgccctgggccatgcaggccgaggagaccaaggggattggaataaccagtatggcaaaatgcttggtcaagatccagactcgacgaagcctccaattgcacatggtgaaccactgcaacagtaatgtgtttgttcgtctgctgagactcggctccaaggtcacagctcgtaacactggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctcctggccattgtatctattatctactgggaactggggtggcggcagggatggtggtgaatattttggatctcggcaacctccaatg

SEQ ID NO: 306095 - DNA, 438 bp, Homo sapiens
ttgagtccctctgggccactctctacagggtggagacaatgtgctgaaggtcgctgcttacttgtcctcctgcttcttttctctctccctctctccttttctcttggacctgcatctgggcttccagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctcctggccattgtatctattatctactgggaactggggtggcggcagggatggtggtgaatattttggatctcggcaacctccaatg

SEQ ID NO: 306096 - DNA, 2536 bp, Homo sapiens
agggggcgaggcggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataacaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatgaagttaatctctcacgtgactaagggctatattcaatgctagtgatttctttttttcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttttgtttttttaaaaatatttttatgtgttcaaactattttggtaaatttttagcaaaaaaa

SEQ ID NO: 306097 - DNA, 1510 bp, Homo sapiens
ggctagagtagggatgatgcataatctttcattgtttgttagaggggtgagtggagagtttaaaaatagcgtcccctccctcctcccctcccaatgctgatccctcatgagttatttctgttggccgcattaggaacctgacatttgattcattcagtgggtcctgcctaggtcctttaaaacagaatggactgttagggaaaggctgccctgggccatgcaggccgaggagaccaaggggattggaataaccagtatggcaaaatgcttggtcaagatccagactcgacgaagcctccaattgcacatggtgaaccactgcaacagtaatgtgtttgttcgtctgctgagactcggctccaaggtcacagctcgtaacactggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatgaagttaatctctcacgtgactaagggctatattcaatgctagtgatttctttttttcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttttgtttttttaaaaatatttttatgtgttcaaactattttggtaaatttttagcaaaaaaa

SEQ ID NO: 306098 - DNA, 1836 bp, Homo sapiens
gcttcatttcggaagtgattcatagcacttctgcttacaactctctgatcaggactcatcccaagatcttacccaggatcaaggaaatgcaattctatggtgttcagaagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcaggtattgatctctccttcttatgcgaaatccgccagacaccagagtttgagcagtttcactatgaatactactgtcccctcaaggagtgggtggctgggaaagtccacctcatcctctacatgctgggttgctcatgaagttaatctctcacgtgactaagggctatattcaatgctagtgatttctttttttcagcaaatgcctggttctgaagggtcacggggctgtcaacaggtgttccttactcataattgattattcaaacctttaagttagctttccataattcactgcacttaaataagtttaaatcaaatacagttattttagttacaggttaggaagatggtctttaaataaccaaaaatatgtttattttttattatagtgtagacatacccttcatctattatatcataatacatgttacattggactgaattagattttcccatttctaatagttggcaccattataagctataaggttcagaatcagaattttagtaacaactcaagagaaagttgttgaatataatccttagtgaaaacagtgtcctctaaccaatgcctatacaactaaatttatgctgggtttttggttttgtttttttaaaaatatttttatgtgttcaaactattttggtaaatttttagcaaaaaaa

SEQ ID NO: 306099 - DNA, 2182 bp, Homo sapiens
agggggcgaggcggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataacaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagagccaacattactcagagccgcagttcccactccttgaacaaacagctcatcattaacatggaacccctgcagcccctgcttccttcccccagcgagcaagaagaagaacttcctctgggtgagggtgttccattgcctaaagaggagaacatttctgctcccttgatctccagctccccagtgaaggcagcccgggagtatgaagatccccctagtgaagaggaagataaaataaaagaagaacctttaaccatctctgaactagtgtacaacccaagtgccagcctgctccccacccctgtggatgacgatgagattgacatgctctttgactgtccttctaggcttgagttggaaagagaagacacagattcatttgaggatctggaagcagatgaaaacgcctttttgattgctgaagaagaggagctgaaggaggctcgccgtgctttgtcgtggagctatgacattctgactggccatattcgggtgaacccactggtcaagagtttttccaggctccttgtggtgggcctgggactgctgctctttgtatttcccctgctcctcctccttttggagtcagtctccatgcagtaaacagacccagcagaacctgcccgtggtgagctcagccaagacttggctctccatgttccagcctccgtctgtgactgggtgggtaagttcggtgggccccacccagtgggctcggcagccgtcacttcacagaagaagaaaggaaccttgcttaggcctcagatcccagctgtgctctccaatccattaataaagctgcttttaaccctctcctggccattgtatctattatctactgggaactggggtggcggcagggatggtggtgaatattttggatctcggcaacctccaatg

SEQ ID NO: 306100 - DNA, 1569 bp, Homo sapiens
agggggcgaggcggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgatccactttcggagctccagcgtcaaatcgctcagccaggagatgagatgcaccatccggctgctggacgactcggagatctcctgccacatccagagggaaaccaaagggcagtttctcattgaccacatctgcaactactacagcctgctggagaaggactactttggcattcgctatgtggacccagagaagcaaaggcactggcttgaacctaacaagtccatcttcaagcaaatgaaaactcatccaccatacaccatgtgctttagagtgaaattctacccacatgaacccttgaagattaaagaagagctcacaagataccttttataccttcagattaaaagggacatttttcatggccgcctgctgtgctccttttctgatgctgcctacctgggtgcctgtattgttcaagctgagcttggtgattacgatcctgatgagcatcctgagaattacatcagtgagtttgagattttccccaagcagtcacagaagctggaaagaaaaatagtggaaattcataacaatgaactcagggggcagagcccaccagttgctgaatttaacttgctcctgaaagctcacactttggaaacctacggggtggatcctcacccatgcaaggattcaacaggcacaacaacatttttaggattcacagctgcaggctttgtggtctttcagggaaataagagaatccatttgataaaatggccagatgtctgcaaattgaagtttgaagggaagacattttatgtgattggcacccagaaggagaaaaaagccatgttggcattccatacttcaacaccagctgcctgcaaacatctttggaagtgtggagtggaaaaccaggccttttataagtatgcaaaatccagtcagatcaagactgtatcaagcagcaagatattttttaaaggaagtagatttcgatatagtgggaaagttgccaaagaggtggtggaggccagttccaagatccagagggagcctcctgaggtgcacagatgtgtacagaagaaaatttgttcctgctttggggtgacttggtgaggagctgtaatgtgaaagtctgcaaaaccaggctatcacactgtaagaagcagaagactacaggatgagagaagctggagaatcttggctccaggcatgttggtgcagatcctgaaagtgcagcctgcccaccaatgagaaaagtctttatggttccctcctcttccccaaattgtacttattcaatgcagcagaaatgaagaggaaatgataaaacatatcattcatctgtttcagaa

SEQ ID NO: 306101 - DNA, 454 bp, Homo sapiens
  misc_feature (40)..(40): n is a, c, g, or t
attccagctcggtttcccttttggggtctttgctgccggncgcggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306102 - DNA, 378 bp, Homo sapiens
  misc_feature (339)..(339): n is a, c, g, or t
gataacatcttatcaggagacttgggccgggcacagtggcgcgtgctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagtgaaaccccatctctactanaaatactaaattagccaggtacaatggcagccctgattt

SEQ ID NO: 306103 - DNA, 564 bp, Homo sapiens
caccactcctatagatcagtcacacccaaacattagtaaaagatgaatcacagacataaatttgcaagctcaaacaataaagcatctaaaagaaaatatagaagaatatcatcatgacttctgagcaggcaaaggtttcttagacataaaggtactaatcataaaaacatatatttatgtctctatgtatccaataaagaacactacaaaataatcataataaaacgacaaacaacccagttgttaaatgaacaacagctgggcatggtagtgcactctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccacgcgcccacaacccacgcgcacaacc

SEQ ID NO: 306104 - DNA, 249 bp, Homo sapiens
  misc_feature (248)..(248): n is a, c, g, or t
gataacatcttatcaggagacttgggccgggcacagtggcgcgtgctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaattcagagccaggcctaagttcagagccang

SEQ ID NO: 306105 - DNA, 170 bp, Homo sapiens
  misc_feature (7)..(8): n is a, c, g, or t
  misc_feature (12)..(12): n is a, c, g, or t
tgagatnncccncaaaccccctctcacccacaaaccccttcacccacaaaccccccgatcgggtgtccgcactaagttcggcatcaatatggtgacctcccgggagcgggggaccaccaggttgcctaaggaggggtgaagtttgtgggtgaaaggggggggtaccgagc

SEQ ID NO: 306106 - DNA, 691 bp, Homo sapiens
  misc_feature (184)..(184): n is a, c, g, or t
  misc_feature (188)..(189): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306107 - DNA, 665 bp, Homo sapiens
  misc_feature (158)..(158): n is a, c, g, or t
  misc_feature (162)..(163): n is a, c, g, or t
aaaaaaaaagccgggcttggtgactcatgcctgtaatcccaaggtgctgagattataggcgtgagccaccacacccggctagttatatgagacttttaaaacataaatgaaccgggcatggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306108 - DNA, 686 bp, Homo sapiens
  misc_feature (179)..(179): n is a, c, g, or t
  misc_feature (183)..(184): n is a, c, g, or t
gatcattttattcctctgggggtactccccggggggtaccaccagagcaaaggatcgcttgagcctaggcattggagaccagcctgggcaacatactgagaccttatttcttcaaaaaatcccaaacacaggccaggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306109 - DNA, 620 bp, Homo sapiens
  misc_feature (113)..(113): n is a, c, g, or t
  misc_feature (117)..(118): n is a, c, g, or t
cctgtactgtgtggcttctcaaatactgctaaggtacagtaagtatttaataagcaaattgtctggtcaggcatggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306110 - DNA, 614 bp, Homo sapiens
  misc_feature (184)..(184): n is a, c, g, or t
  misc_feature (188)..(189): n is a, c, g, or t
  misc_feature (575)..(575): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagtgaaaccccatctctactanaaatactaaattagccaggtacaatggcagccctgattt

SEQ ID NO: 306111 - DNA, 741 bp, Homo sapiens
  misc_feature (184)..(184): n is a, c, g, or t
  misc_feature (188)..(189): n is a, c, g, or t
  misc_feature (506)..(506): n is a, c, g, or t
  misc_feature (513)..(513): n is a, c, g, or t
  misc_feature (517)..(517): n is a, c, g, or t
  misc_feature (519)..(519): n is a, c, g, or t
  misc_feature (741)..(741): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtantgggaancccncntgtaataagcaattgaactccagcctggggccacaaagggagactctgtctcttaagtaaacatagaatattattgattcataaaatcatgattttgaaaattaatgacatgaaaaatatgcacaatatatttcagaaagcaaaatgtataatttcatttaaaaaatgcatagcatggtcccagctttgtgtgtatctggtgccaataaagctcacagcaan

SEQ ID NO: 306112 - DNA, 750 bp, Homo sapiens
  misc_feature (184)..(184): n is a, c, g, or t
  misc_feature (188)..(189): n is a, c, g, or t
  misc_feature (509)..(509): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtgatgnctcaagaagttttgcaaaggagactagagccttgaagatgaggagtgcagtggccagtcatcggaaattgataatgaccaattgagaacatcaatcgaagctgatcctcttacaactataagagagctgcccaagaactcaatgttgaccattttatggtcgttccggcatttgaagcaaattgaaaaggtgaaaaagctccaataaatggggtgcctcatgaactgagtgaaaaataaaa

SEQ ID NO: 306113 - DNA, 671 bp, Homo sapiens
aaatgtgctcagaacacttacattagcctacagttgggaaaaatcatctaacacaaagcctattttataatgaagtgttgagtattgcatgtaatttactgaacaaatactatactgaagtagtttctactgaatgtgtactgcttttgcaccacaggttgaaaaactgtgtaaatcagaaagtctgcatacaattattagttatttatttcccttgtgttaagaaataaaactggctgggcgctgtggcttacgcctgtaatggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306114 - DNA, 884 bp, Homo sapiens
acttcttagagaaaaggtgtgtgctggtgtctccaagtctaatgatttcaccagtggattctgcttcatctccatcccaagaggggcccaacatctcagaagacaaggagcacctggaaaagttccctccttcactcagggcccagcctgaccagagggcccttcccctgaggacctggagagctgctgggtgcagaaaaaggaaaagactctcccttttgctgcttagcatgtcttgctgcttatgttttgttttcactgatatatgaatggtagaaatagctgtatataaagtgtcaacgattaaatgtataggagaacagcaaatactggtgactctagggtgtgggagtgaagggggtgggatgctaactttgcattaaatatccttcaattgtttcacttttgcgcttattttgttactttaaaattcttatggaaagaagttcaccaggccgggcatggtagctcactctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306115 - DNA, 528 bp, Homo sapiens
tgtgcctcttgcgtggtacatcctcccgggatgcgggggaccaccagattgcctaaggaggtgtgaacggccaggtcggaaacggagcaggtcaaaactcccgtgctgatcagtagtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306116 - DNA, 687 bp, Homo sapiens
caccactcctatagatcagtcacacccaaacattagtaaaagatgaatcacagacataaatttgcaagctcaaacaataaagcatctaaaagaaaatatagaagaatatcatcatgacttctgagcaggcaaaggtttcttagacataaaggtactaatcataaaaacatatatttatgtctctatgtatccaataaagaacactacaaaataatcataataaaacgacaaacaacccagttgttaaatgaacaacagctgggcatggtagtgcactctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306117 - DNA, 532 bp, Homo sapiens
gagtctgaggatccggtgaatcctcctcctcctgccagagaaataaatgccagcagctgtttattctctcaggcccaccaacacatctttttacaaataaatttgcctcacagctggtcatggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306118 - DNA, 485 bp, Homo sapiens
  misc_feature (16)..(16): n is a, c, g, or t
  misc_feature (19)..(20): n is a, c, g, or t
  misc_feature (26)..(26): n is a, c, g, or t
  misc_feature (31)..(31): n is a, c, g, or t
  misc_feature (36)..(36): n is a, c, g, or t
  misc_feature (40)..(40): n is a, c, g, or t
  misc_feature (45)..(45): n is a, c, g, or t
  misc_feature (59)..(59): n is a, c, g, or t
ccgctctccacccacnccnnccaccntgccnggctnattnttgtntttttagtagaganggggtttcaccatgttgtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306119 - DNA, 435 bp, Homo sapiens
atgtactcctccctctccttaggcaatggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306120 - DNA, 640 bp, Homo sapiens
agccatgagttttggtttagaagatggaatttccagtgagaccagatggttataagtctccagcatcacctccctgtgcagggtcctctgagcagggctcaacaacctccactcctcctgggtgaagtacacagccacatccctgaatgccacgaacgcctttaacacaaaacacacctctgctcacccaggagcctgtctttccctcccacactttagaatgagaggtcatggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306121 - DNA, 500 bp, Homo sapiens
tgtgcctcttgcgtggtacatcctcccgggatgcgggggaccaccagattgcctaaggaggtgtgaacggccaggtcggaaacggagcaggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306122 - DNA, 608 bp, Homo sapiens
atcgctgacctcttcctgttccacatctggaaagtgtgaacaaaacaccttactcatttatatcccaagtaccaagtatatactgggtactaaaaattcataaaattgtggtaaactttttatattgttttacatttcctgtttcctcttgcaaatttcaccttattcttcctacatcttttgaaaaatcacttcctgctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306123 - DNA, 455 bp, Homo sapiens
gataacatcttatcaggagacttgggccgggcacagtggcgcgtgctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306124 - DNA, 556 bp, Homo sapiens
gcccaggcggagcagcctcctgtccgaagggcatgagatagtgttccacgttaggggccactagacgcgctcgtggcttgtcgctgtcgtcagctgatgaccaccgcggacgcgttgggtagaagcggcggatactggtgatgagagtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306125 - DNA, 461 bp, Homo sapiens
cctaagtggaactgctccgaaaaataaattaaaaaaaacaaaacaaacaaactggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306126 - DNA, 473 bp, Homo sapiens
catcatggcaaatctcatctctacttaaaatttaaaaaaaaaaattagccagtcttggtattggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306127 - DNA, 464 bp, Homo sapiens
tgaaacctctgtgagattttcccggcgtggtggcatggctgcctgtttatcccagtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306128 - DNA, 464 bp, Homo sapiens
  misc_feature (7)..(8): n is a, c, g, or t
  misc_feature (12)..(12): n is a, c, g, or t
tgagatnncccncaaaccccctctcacccacaaaccccttcacccacaaaccccctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306129 - DNA, 465 bp, Homo sapiens
gcctaagtggaactgctcgtatctactaaaaatacaaaaatgatggctgggcgttgtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306130 - DNA, 479 bp, Homo sapiens
cttggtggtacctccaggctggagtgcagtgtcacaatcttggctcactgcaatctctgcctcccaggtctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306131 - DNA, 469 bp, Homo sapiens
agccttcccaggctcaggaagcatggaaatgagtctgggaggtgattctcccaactcagctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306132 - DNA, 461 bp, Homo sapiens
atcctcctcctccttactaagaagtaaattagctgggtgtggtgatgggcactggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttaagtccctttattgcattcagagaatatataggtatttaaactgtgacaataattttaccttgatacatccaagtttgacttgctttataatatattatagatataaacttagcctcttt

SEQ ID NO: 306133 - DNA, 541 bp, Homo sapiens
  misc_feature (184)..(184): n is a, c, g, or t
  misc_feature (188)..(189): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaagagagggggtctcgctatgttgcccaggctggagtgcagtggctattcacaggcgcgatcccactactgatcagcacgggagttt

SEQ ID NO: 306134 - DNA, 485 bp, Homo sapiens
  misc_feature (184)..(184): n is a, c, g, or t
  misc_feature (188)..(189): n is a, c, g, or t
  misc_feature (484)..(484): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaattcagagccaggcctaagttcagagccang

SEQ ID NO: 306135 - DNA, 488 bp, Homo sapiens
  misc_feature (184)..(184): n is a, c, g, or t
  misc_feature (188)..(189): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaggtgcgttggcccaacacggtgcgttggcccgg

SEQ ID NO: 306136 - DNA, 485 bp, Homo sapiens
  misc_feature (184)..(184): n is a, c, g, or t
  misc_feature (188)..(189): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaagactggagacgggatactctagagactgac

SEQ ID NO: 306137 - DNA, 620 bp, Homo sapiens
  misc_feature (184)..(184): n is a, c, g, or t
  misc_feature (188)..(189): n is a, c, g, or t
  misc_feature (471)..(471): n is a, c, g, or t
  misc_feature (545)..(545): n is a, c, g, or t
  misc_feature (616)..(616): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaatctggggttcagcctngagctagtgtcacctgcacagggccctctgaggctcagcctgagctggcgtcacctgtgcagggccctctgggntcagcccttgagctggcctcacctgggttccccaccccgggctctcctgccctgccctcctgcacgccctncctc

SEQ ID NO: 306138 - DNA, 507 bp, Homo sapiens
  misc_feature (184)..(184): n is a, c, g, or t
  misc_feature (188)..(189): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaatcgtcccgtcgcatgtgatcgacagtgttccgggcctcacgctcacaggttt

SEQ ID NO: 306139 - DNA, 485 bp, Homo sapiens
  misc_feature (184)..(184): n is a, c, g, or t
  misc_feature (188)..(189): n is a, c, g, or t
ctgcgctctcttgcgattatatgaatctttgtcatttcgtatgctcatgcattagtaaaaaaaaaaaatacaatgaagagattacttcattcacaaataagtatcgaattttagtgcttaaaaattaacaaggtgggccgggtgtggtggctcacgcctgtaatcccagcactttgggaggccnaggnnggaggatcacttgaggccaggagttcgagaccagcctggccaacatggtgaaaccccgtctctactaaaaatacaaaaattagccgggcgtggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaagtttgtgggtgaaaggggggggtaccgagc

SEQ ID NO: 306140 - DNA, 658 bp, Homo sapiens
acttcttagagaaaaggtgtgtgctggtgtctccaagtctaatgatttcaccagtggattctgcttcatctccatcccaagaggggcccaacatctcagaagacaaggagcacctggaaaagttccctccttcactcagggcccagcctgaccagagggcccttcccctgaggacctggagagctgctgggtgcagaaaaaggaaaagactctcccttttgctgcttagcatgtcttgctgcttatgttttgttttcactgatatatgaatggtagaaatagctgtatataaagtgtcaacgattaaatgtataggagaacagcaaatactggtgactctagggtgtgggagtgaagggggtgggatgctaactttgcattaaatatccttcaattgtttcacttttgcgcttattttgttactttaaaattcttatggaaagaagttcaccaggccgggcatggtagctcactctggcgcgtgcctgtagtcccagctactcgggaggctgaggtgggaggatcgcttgagcccaggagttctgggctgtagtgcgctatgccgatcgggtgtccgcactaagttcggcatcaatatggtgacctcttccacactctgtgctgtcctcctctgccctccttatgctgggccaggcta

SEQ ID NO: 306141 - DNA, 1570 bp, Homo sapiens
gtctaatgaaaaggcactcgggagctatttctgaacggacctgggcttgtcggaccagtgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggaggagtatatattctggggaaatatggacagaagaaaatcagagaaatacaggaaagggaggctgcagaatacattgcccaagcacgacgacaatatcattttgaaagtaaccagaggacttgcaatatgacagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaatagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttattt

SEQ ID NO: 306142 - DNA, 1051 bp, Homo sapiens
agaatatctgattgggtataggcaagagaaagaagtgccagggataatgcccatatttgctgcttctagaacctgatagataatggtgtggttcactggagtaggggggaaatactcaacattgttagtaattaagagaaatgcagatttaacctgtaagatactattttcacctatcagatgtgaaagattaaagaaaaggataatgttggatgttgaaagaaggcataatggagcagatacattcataccctttgacccagtgatttcatgtttatacaaaatcttacttagattaagaaaatttaggcaaaaactgaaatgcccaactctagggaactcatgatataaattgtcacagctagaggacagattactgtatagtcattaaaaaacaatcagacaaacactttagaacttttaataagatggaaaatactcataacaataaaaatgcaaaaacagtgtgcttaggaggttagaggtttttggtagacacaaaaaaacaaagatatgtgtaaaaaaacgccaaaagaaattggtcatgatgtcaattagagttgttatttctaagcgatagaattgtggggttttttttcctttttaatagatttccaaaaatattctacaatggctatgtattacttttataattaagatgttaaagtcctgtggggtcatttcagaaaataatcattactgtaatgatttttcagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttattt

SEQ ID NO: 306143 - DNA, 296 bp, Homo sapiens
tccaggatgatacctaaatggctgtatcataaccctgtgctaatgtttgaaaaccttaagtgtgacattttaattctataggcctgtggactttctcctcgagacattaccactattaaacttctcaatgaaactagagacatgttggaaaggtatgtatacttcatgtagcaggaaaaatatgtgtgtatgttgaatgtacttgagactattttttagtttttcttgaacaacatggtcggtataatattatattaaaattaaatttttgactctgttccacagccatttaggta

SEQ ID NO: 306144 - DNA, 310 bp, Homo sapiens
agaatcattcttctgggaatatgacaggaatgcctatctgtcacacctaaaattccgggtttttttttacaaagttttatttcacttccctagttcaaccactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttattt

SEQ ID NO: 306145 - DNA, 2195 bp, Homo sapiens
gtctaatgaaaaggcactcgggagctatttctgaacggacctgggcttgtcggaccagtgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggaggagtatatattctggggaaatatggacagaagaaaatcagagaaatacaggaaagggaggctgcagaatacattgcccaagcacgacgacaatatcattttgaaagtaaccagaggacttgcaatatgacagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaatagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatatataaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagta

SEQ ID NO: 306146 - DNA, 4381 bp, Homo sapiens
gtctaatgaaaaggcactcgggagctatttctgaacggacctgggcttgtcggaccagtgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggaggagtatatattctggggaaatatggacagaagaaaatcagagaaatacaggaaagggaggctgcagaatacattgcccaagcacgacgacaatatcattttgaaagtaaccagaggacttgcaatatgacagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaatagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatatataaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaatattattttgttgagttaatatttttcagctattaatttacttatcccatagcatttttgttattatttcggaagagagagcatgctagtttaagtttcattttaattggtcgtgtacttggtgcttttttgttgttgttaacttgttcatttagtaaaaagcaaatagctttactttctgaaaaagaaataattcattatctctagtaatacatctgtaattcttcatttagaagggtaattagggcaaaagtaaataaatcattatatatcattagtatgttgacatatattttcagtaacattgttttatgttcctccagcgtaacatgtagctgaacagtagaaggtagaaaataaattatgacatctcttctaaggcctggctaggcctgaagctcactgccagggagtttgtgtctagaatgtttttaaaaataggtagtggagccatagccctcaccatagacacctctgagcccactggcattgtctctgagcagaagatggctgtgccactcacatatgctaatcttggcaaatctgccaagcatgtcttcaccaagggatatggatttggcttaataaaacctgatttgaaaacaaaatctgagaatggattggaatttacaagctcaggctcagccaacactgagaccaccaaagtgacaggcagtctggaaaccaagtacagatagaccgaatatggcctgacatttgcaaagaaatggaacactgacaacacactaggcaccgagattactatggaagaccagttagcatgtggactgaagctgaccctccattcatccttctcgcctaacactgggggaaaagtgctaaaatcaagacaggatacaagtgggagcacattaacctgggctgcgacgtggatttggacattgctgagccttcagtccgaggcactcttaagtgctgggttatgaggattggctggccagctaccaggtcaattttgagaccacaaagtcctgagtgacccagagcaactttgcggttggccacaagactgatgaattccagcttcacactaatgtgaatgacgggacagagtttggcagctccaattagcagaaggtgagcaagaagttggagactgctgtcagtctcgctgggacagcaagaaacaggaacactcgcttcagaatagcagccaagtatcagatcgatcctaaagcccacttctccactaaagtgaacaactccagcctgataggtttaggatacacttaaaccctaaagccaggtttcatactgacactgtcagctctcctgggtggcaagaacatctatgctagtggccacaagcttggtctaggactggaatttcaagcataaatgaatgctgtagaattgtttaaattattttgcagcatagataccttcacaatttagtgtatcttttaatgttgtatggctgggatgcaagtattgctaaatgtcatattggacctccaggttaaagatgattcagctttaaggtgttaccctttcaggggtacagaagaaacccagttccaaaaaggtcccttcagtggtagatttggggaacttggtggcccctgtagagatgccaggtttcttttttatctagaaatggctgcaagtggaagctgataatatataggcaccttgtaaattcatattgagtaaatgaatgaaattgtgatttcctgagaattgaaccttggtttcctaaccctaactgatgagaggcttgttgcttgatggtgtgtacaaatttacctgaaagggaccttttaaagacagatcttcatgacttgttcccatcccaggtcttcattacctcttttacacaaaaagatctacagggtgtggtcactgtttcttttgtgctgttttggggtggagagggtggatgtgatgaagccaataattcaggacttaattccttcctgagttgtggtttttttgtccttgcatcagtgtataaaatagcttccaggagctctagctataagcttggaagagtctgtataattgtaatcacagggtgacagcactcagaatctaaactgggcttatgtggtattctcaccactcaatttattttttagcagtttaatgggtacattttagagtcttccattttgtgtggaattagatcctcttcctcaaatgctgtaattaacttaaaaaaa

SEQ ID NO: 306147 - DNA, 4284 bp, Homo sapiens
gtctaatgaaaaggcactcgggagctatttctgaacggacctgggcttgtcggaccagtgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggaggagtatatattctggggaaatatggacagaagaaaatcagagaaatacaggaaagggaggctgcagaatacattgcccaagcacgacgacaatatcattttgaaagtaaccagaggacttgcaatatgacagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaataggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatatataaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaatattattttgttgagttaatatttttcagctattaatttacttatcccatagcatttttgttattatttcggaagagagagcatgctagtttaagtttcattttaattggtcgtgtacttggtgcttttttgttgttgttaacttgttcatttagtaaaaagcaaatagctttactttctgaaaaagaaataattcattatctctagtaatacatctgtaattcttcatttagaagggtaattagggcaaaagtaaataaatcattatatatcattagtatgttgacatatattttcagtaacattgttttatgttcctccagcgtaacatgtagctgaacagtagaaggtagaaaataaattatgacatctcttctaaggcctggctaggcctgaagctcactgccagggagtttgtgtctagaatgtttttaaaaataggtagtggagccatagccctcaccatagacacctctgagcccactggcattgtctctgagcagaagatggctgtgccactcacatatgctaatcttggcaaatctgccaagcatgtcttcaccaagggatatggatttggcttaataaaacctgatttgaaaacaaaatctgagaatggattggaatttacaagctcaggctcagccaacactgagaccaccaaagtgacaggcagtctggaaaccaagtacagatagaccgaatatggcctgacatttgcaaagaaatggaacactgacaacacactaggcaccgagattactatggaagaccagttagcatgtggactgaagctgaccctccattcatccttctcgcctaacactgggggaaaagtgctaaaatcaagacaggatacaagtgggagcacattaacctgggctgcgacgtggatttggacattgctgagccttcagtccgaggcactcttaagtgctgggttatgaggattggctggccagctaccaggtcaattttgagaccacaaagtcctgagtgacccagagcaactttgcggttggccacaagactgatgaattccagcttcacactaatgtgaatgacgggacagagtttggcagctccaattagcagaaggtgagcaagaagttggagactgctgtcagtctcgctgggacagcaagaaacaggaacactcgcttcagaatagcagccaagtatcagatcgatcctaaagcccacttctccactaaagtgaacaactccagcctgataggtttaggatacacttaaaccctaaagccaggtttcatactgacactgtcagctctcctgggtggcaagaacatctatgctagtggccacaagcttggtctaggactggaatttcaagcataaatgaatgctgtagaattgtttaaattattttgcagcatagataccttcacaatttagtgtatcttttaatgttgtatggctgggatgcaagtattgctaaatgtcatattggacctccaggttaaagatgattcagctttaaggtgttaccctttcaggggtacagaagaaacccagttccaaaaaggtcccttcagtggtagatttggggaacttggtggcccctgtagagatgccaggtttcttttttatctagaaatggctgcaagtggaagctgataatatataggcaccttgtaaattcatattgagtaaatgaatgaaattgtgatttcctgagaattgaaccttggtttcctaaccctaactgatgagaggcttgttgcttgatggtgtgtacaaatttacctgaaagggaccttttaaagacagatcttcatgacttgttcccatcccaggtcttcattacctcttttacacaaaaagatctacagggtgtggtcactgtttcttttgtgctgttttggggtggagagggtggatgtgatgaagccaataattcaggacttaattccttcctgagttgtggtttttttgtccttgcatcagtgtataaaatagcttccaggagctctagctataagcttggaagagtctgtataattgtaatcacagggtgacagcactcagaatctaaactgggcttatgtggtattctcaccactcaatttattttttagcagtttaatgggtacattttagagtcttccattttgtgtggaattagatcctcttcctcaaatgctgtaattaacttaaaaaaa

SEQ ID NO: 306148 - DNA, 2309 bp, Homo sapiens
gtctaatgaaaaggcactcgggagctatttctgaacggacctgggcttgtcggaccagtgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggaggagtatatattctggggaaatatggacagaagaaaatcagagaaatacaggaaagggaggctgcagaatacattgcccaagcacgacgacaatatcattttgaaagtaaccagaggacttgcaatatgacagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaatagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttcctgtttaccaaaaacatcacctctagcatcaccagtattagaggcaccgcctgcccagtgacacatgtttaacggccgcggtaccctaaccgtgcaaaggtagcataatcacttgttccttaaatagggacctgtatgaatggctccacgagggttcagctgtctcttacttttaaccagtgaaattgacctgcccgtgaagaggcgggcatgacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggccggtttctatctacttcaaattcctccctgtacgaaaggacaagagaaataaggcctacttcacaaagcgccttcccccgtaaatgatatcatctcaacttagtattatacccacacccacccaagaacagggtttgtt

SEQ ID NO: 306149 - DNA, 4326 bp, Homo sapiens
gtctaatgaaaaggcactcgggagctatttctgaacggacctgggcttgtcggaccagtgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggaggagtatatattctggggaaatatggacagaagaaaatcagagaaatacaggaaagggaggctgcagaatacattgcccaagcacgacgacaatatcattttgaaagtaaccagaggacttgcaatatgacagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaatagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatatataaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaatattattttgttgagttaatatttttcagctattaatttacttatcccatagcatttttgttattatttcggaagagagagcatgctagtttaagtttcattttaattggtcgtgtacttggtgcttttttgttgttgttaacttgttcatttagtaaaaagcaaatagctttactttctgaaaaagaaataattcattatctctagtaatacatctgtaattcttcatttagaagggtaattagggcaaaagtaaataaatcattatatatcattagtatgttgacatatattttcagtaacattgttttatgttcctccagcgtaacatgtagctgaacagtagaaggtagaaaataaattatgacatctcttctaaggcctggctaggcctgaagctcactgccagggagtttgtgtctagaatgtttttaaaaataggtagtggagccatagccctcaccatagacacctctgagcccactggcattgtctctgagcagaagatggctgtgccactcacatatgctaatcttggcaaatctgccaagcatgtcttcaccaagggatatggatttggcttaataaaacctgatttgaaaacaaaatctgagaatggattggaatttacaagctcaggctcagccaacactgagaccaccaaagtgacaggcagtctggaaaccaagtacagatagaccgaatatggcctgacatttgcaaagaaatggaacactgacaacacactaggcaccgagattactatggaagaccagttagcatgtggactgaagctgaccctccattcatccttctcgcctaacactgggggaaaagtgctaaaatcaagacaggatacaagtgggagcacattaacctgggctgcgacgtggatttggacattgctgagccttcagtccgaggcactcttaagtgctgggttatgaggattggctggccagctaccaggtcaattttgagaccacaaagtcctgagtgacccagagcaactttgcggttggccacaagactgatgaattccagcttcacactaatgtgaatgacgggacagagtttggcagctccaattagcagaaggtgagcaagaagttggagactgctgtcagtctcgctgggacagcaagaaacaggaacactcgcttcagaatagcagccaagtatcagatcgatcctaaagcccacttctccactaaagtgaacaactccagcctgataggtttaggatacacttaaaccctaaagccaggtttcatactgacactgtcagctctcctgggtggcaagaacatctatgctagtggccacaagcttggtctaggactggaatttcaagcataaatgaatgctgtagaattgtttaaattattttgcagcatagataccttcacaatttagtgtatcttttaatgttgtatggctgggatgcaagtattgctaaatgtcatattggacctccaggttaaagatgattcagctttaaggtgttaccctttcaggggtacagaagaaacccagttccaaaaaggtcccttcagtggtagatttggggaacttggtggcccctgtagagatgccaggtttcttttttatctagaaatggctgcaagtggaagctgataatatataggcaccttgtaaattcatattgagtaaatgaatgaaattgtgatttcctgagaattgaaccttggtttcctaaccctaactgatgagaggcttgttgcttgatggtgtgtacaaatttacctgaaagggaccttttaaagacagatcttcatgacttgttcccatcccaggtcttcattacctcttttacacaaaaagatctacagggtgtggtcactgtttcttttgtgctgttttggggtggagagggtggatgtgatgaagccaataattcaggacttaattccttcctgagttgtggtttttttgtccttgcatcagtgtataaaatagcttccaggagctctagctataagcttggaagagtctgtataattgtaatcacagggtgacagcactcagaatctaaactgggcttatgtggtattctcaccactcaatttattttttagcagtttaatgggtacattttagagtcttccattttgtgtggaattagatcctcttcctcaaatgctgtaattaacttaaaaaaa

SEQ ID NO: 306150 - DNA, 4249 bp, Homo sapiens
gtctaatgaaaaggcactcgggagctatttctgaacggacctgggcttgtcggaccagtgagcggcggcggctgcgcggcggcagcggcagaaagcgtagctgctttgctgtagtccacgcccccttgccgctccggtgacagtctctgcggaaagtcacgtttgtgatttcgggagagcacagaacgggacgacggcgctcttgctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggagtgctgtccatgcttccaacactgagagaggccttaatgcagcaactgaattccgagagcctcacagctctgctaaaaaacaggccttcaaacaagctagaaatatgggaggatctgaagataataagtttcacaagaagtactgtggctgtatacagtacctgtatgctggttgttcttttgcgggtccagttaaacataattggtggatatatttacctggataatgcagcagttggcaaaaatggcactacaattcttgctcccccagatgtccaacagcagtatttatcaagtattcagcacctacttggagatggcctgacagaattgatcactgtcattaaacaagctgtgcagaaggttttaggaagtgtttctcttaaacattctttgtcccttttggacttggagcaaaaactaaaagaaatcagaaatctcgttgagcagcataagtcttcttcttggattaataaagatggatccaaacctttattatgccattatatgatgccagatgaagaaactccattagcagtgcaggcctgtggactttctcctcgagacattaccactattaaacttctcaatgaaactagagacatgttggaaagcccagattttagtacagttttgaatacctgtttaaaccgaggttttagtagacttctagacaatatggctgagttctttcgacctactgaacaggacctgcaacatggtaactctatgaatagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatatataaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaatattattttgttgagttaatatttttcagctattaatttacttatcccatagcatttttgttattatttcggaagagagagcatgctagtttaagtttcattttaattggtcgtgtacttggtgcttttttgttgttgttaacttgttcatttagtaaaaagcaaatagctttactttctgaaaaagaaataattcattatctctagtaatacatctgtaattcttcatttagaagggtaattagggcaaaagtaaataaatcattatatatcattagtatgttgacatatattttcagtaacattgttttatgttcctccagcgtaacatgtagctgaacagtagaaggtagaaaataaattatgacatctcttctaaggcctggctaggcctgaagctcactgccagggagtttgtgtctagaatgtttttaaaaataggtagtggagccatagccctcaccatagacacctctgagcccactggcattgtctctgagcagaagatggctgtgccactcacatatgctaatcttggcaaatctgccaagcatgtcttcaccaagggatatggatttggcttaataaaacctgatttgaaaacaaaatctgagaatggattggaatttacaagctcaggctcagccaacactgagaccaccaaagtgacaggcagtctggaaaccaagtacagatagaccgaatatggcctgacatttgcaaagaaatggaacactgacaacacactaggcaccgagattactatggaagaccagttagcatgtggactgaagctgaccctccattcatccttctcgcctaacactgggggaaaagtgctaaaatcaagacaggatacaagtgggagcacattaacctgggctgcgacgtggatttggacattgctgagccttcagtccgaggcactcttaagtgctgggttatgaggattggctggccagctaccaggtcaattttgagaccacaaagtcctgagtgacccagagcaactttgcggttggccacaagactgatgaattccagcttcacactaatgtgaatgacgggacagagtttggcagctccaattagcagaaggtgagcaagaagttggagactgctgtcagtctcgctgggacagcaagaaacaggaacactcgcttcagaatagcagccaagtatcagatcgatcctaaagcccacttctccactaaagtgaacaactccagcctgataggtttaggatacacttaaaccctaaagccaggtttcatactgacactgtcagctctcctgggtggcaagaacatctatgctagtggccacaagcttggtctaggactggaatttcaagcataaatgaatgctgtagaattgtttaaattattttgcagcatagataccttcacaatttagtgtatcttttaatgttgtatggctgggatgcaagtattgctaaatgtcatattggacctccaggttaaagatgattcagctttaaggtgttaccctttcaggggtacagaagaaacccagttccaaaaaggtcccttcagtggtagatttggggaacttggtggcccctgtagagatgccaggtttcttttttatctagaaatggctgcaagtggaagctgataatatataggcaccttgtaaattcatattgagtaaatgaatgaaattgtgatttcctgagaattgaaccttggtttcctaaccctaactgatgagaggcttgttgcttgatggtgtgtacaaatttacctgaaagggaccttttaaagacagatcttcatgacttgttcccatcccaggtcttcattacctcttttacacaaaaagatctacagggtgtggtcactgtttcttttgtgctgttttggggtggagagggtggatgtgatgaagccaataattcaggacttaattccttcctgagttgtggtttttttgtccttgcatcagtgtataaaatagcttccaggagctctagctataagcttggaagagtctgtataattgtaatcacagggtgacagcactcagaatctaaactgggcttatgtggtattctcaccactcaatttattttttagcagtttaatgggtacattttagagtcttccattttgtgtggaattagatcctcttcctcaaatgctgtaattaacttaaaaaaa

SEQ ID NO: 306151 - DNA, 3862 bp, Homo sapiens
agaatatctgattgggtataggcaagagaaagaagtgccagggataatgcccatatttgctgcttctagaacctgatagataatggtgtggttcactggagtaggggggaaatactcaacattgttagtaattaagagaaatgcagatttaacctgtaagatactattttcacctatcagatgtgaaagattaaagaaaaggataatgttggatgttgaaagaaggcataatggagcagatacattcataccctttgacccagtgatttcatgtttatacaaaatcttacttagattaagaaaatttaggcaaaaactgaaatgcccaactctagggaactcatgatataaattgtcacagctagaggacagattactgtatagtcattaaaaaacaatcagacaaacactttagaacttttaataagatggaaaatactcataacaataaaaatgcaaaaacagtgtgcttaggaggttagaggtttttggtagacacaaaaaaacaaagatatgtgtaaaaaaacgccaaaagaaattggtcatgatgtcaattagagttgttatttctaagcgatagaattgtggggttttttttcctttttaatagatttccaaaaatattctacaatggctatgtattacttttataattaagatgttaaagtcctgtggggtcatttcagaaaataatcattactgtaatgatttttcagtctttccagtgtcagcctgcctttagctaagataattccaatagtaaacggacagatccattcagtttgcagtgaaacacctagtcattttgttcaggatctgttgacaatggagcaagtgaaagactttgctgctaatgtgtatgaagcttttagtacccctcagcaactggagaaatgatttttccttcaagaaaaactacagtgggattcatttactttttaaaatacactgggtaaatcacctatacttagagtaacagtttgttatcaaaatgcctgataaaatatattcttaataaaagtcttcatttcataatgaaatcaatttatttggcatcttaatatatttttttagattcatcaacagaccagtttttgtgggcatatatatatacacgtgcaaatatcagaattgttaataatttgttacacatggacatttgttccaaactgactaaaaatcaatatagatattttatatacatatatatatatataaatacaaaattcagtgtactttaccatattaatactgaggaaaaatctgttggagacataggtctaggatgtgtgaagtttggaaaaatatgctatttaattataatgttccctagactgctgtaaacagaagtgaatcagacttttctccagctacctttcaaaataataaattatttgtctcaaatataccttgatggaggacttttttattcttatggaaatagtgaattccaacaactatgatgaactatgttctttgctatttcttcactatattttttaaggttttattaaaaagccttagaaagttacatattggtttagaggctaaaattgtgttgatgctgtttactcacctaattacatagttttaatcatttgtacataattttaaaaacttactttgtattgattttgaatacagtgaaaatcttattgcaataaactattttagtaaaatattattttgttgagttaatatttttcagctattaatttacttatcccatagcatttttgttattatttcggaagagagagcatgctagtttaagtttcattttaattggtcgtgtacttggtgcttttttgttgttgttaacttgttcatttagtaaaaagcaaatagctttactttctgaaaaagaaataattcattatctctagtaatacatctgtaattcttcatttagaagggtaattagggcaaaagtaaataaatcattatatatcattagtatgttgacatatattttcagtaacattgttttatgttcctccagcgtaacatgtagctgaacagtagaaggtagaaaataaattatgacatctcttctaaggcctggctaggcctgaagctcactgccagggagtttgtgtctagaatgtttttaaaaataggtagtggagccatagccctcaccatagacacctctgagcccactggcattgtctctgagcagaagatggctgtgccactcacatatgctaatcttggcaaatctgccaagcatgtcttcaccaagggatatggatttggcttaataaaacctgatttgaaaacaaaatctgagaatggattggaatttacaagctcaggctcagccaacactgagaccaccaaagtgacaggcagtctggaaaccaagtacagatagaccgaatatggcctgacatttgcaaagaaatggaacactgacaacacactaggcaccgagattactatggaagaccagttagcatgtggactgaagctgaccctccattcatccttctcgcctaacactgggggaaaagtgctaaaatcaagacaggatacaagtgggagcacattaacctgggctgcgacgtggatttggacattgctgagccttcagtccgaggcactcttaagtgctgggttatgaggattggctggccagctaccaggtcaattttgagaccacaaagtcctgagtgacccagagcaactttgcggttggccacaagactgatgaattccagcttcacactaatgtgaatgacgggacagagtttggcagctccaattagcagaaggtgagcaagaagttggagactgctgtcagtctcgctgggacagcaagaaacaggaacactcgcttcagaatagcagccaagtatcagatcgatcctaaagcccacttctccactaaagtgaacaactccagcctgataggtttaggatacacttaaaccctaaagccaggtttcatactgacactgtcagctctcctgggtggcaagaacatctatgctagtggccacaagcttggtctaggactggaatttcaagcataaatgaatgctgtagaattgtttaaattattttgcagcatagataccttcacaatttagtgtatcttttaatgttgtatggctgggatgcaagtattgctaaatgtcatattggacctccaggttaaagatgattcagctttaaggtgttaccctttcaggggtacagaagaaacccagttccaaaaaggtcccttcagtggtagatttggggaacttggtggcccctgtagagatgccaggtttcttttttatctagaaatggctgcaagtggaagctgataatatataggcaccttgtaaattcatattgagtaaatgaatgaaattgtgatttcctgagaattgaaccttggtttcctaaccctaactgatgagaggcttgttgcttgatggtgtgtacaaatttacctgaaagggaccttttaaagacagatcttcatgacttgttcccatcccaggtcttcattacctcttttacacaaaaagatctacagggtgtggtcactgtttcttttgtgctgttttggggtggagagggtggatgtgatgaagccaataattcaggacttaattccttcctgagttgtggtttttttgtccttgcatcagtgtataaaatagcttccaggagctctagctataagcttggaagagtctgtataattgtaatcacagggtgacagcactcagaatctaaactgggcttatgtggtattctcaccactcaatttattttttagcagtttaatgggtacattttagagtcttccattttgtgtggaattagatcctcttcctcaaatgctgtaattaacttaaaaaaa

SEQ ID NO: 306152 - DNA, 521 bp, Homo sapiens
gctgggtcatctgggccaggtgacgaagaaacagtttcctggtgaagcagtccctcacccctagtcagcccacacccctagggcctaaagatgctgaggtctgtatggaattttctgaaacgccacaaaaagaaatgcatcttcctgggcacggtccttggaggtgggtgacaacgtgcttgaaagggggcattgggagaagggggtgggagaggtgacttcttctaaaataaggacaggccgggcgatcctagtctgggatatgtagagggagttcgatcaaccatgggatgaaaagggaggtggccaacctccagggttctcccatctctgcagttgagaaatgcctctgtgccctttgccctgtcaccgactcttaactctgtttctcacctatccttttttctcacggacctttggagaactcatcacagtttaagtttctgtttcaaggcaccattctcttacaggaactttttaaaaaaaattctgctttcctgtgagattctgcatttctcctt

SEQ ID NO: 306153 - DNA, 395 bp, Homo sapiens
cagggatgttctctcctcctgaacaggtttgctcatcattgctttgggcaaaaagagccattctctgacctttcagccctagaccctagccgggcagatgatggagaaatggttagatggagaaatggttagaggatgggcaggcaggagacaaataggctctccaccacctttgtacaaatatttcagaaagtcattgtgttaggacgctctggagttatgaaacacatgcagcctttagagaacttctggttccattcttgcatcttaaaactaggacctggaagtctgcacaacccttgatatttattaacatttactgctcacctgttgtgtgggaagtcctatgccatgcatgtcgttcacattaacttgtgcaattctcaaaacaaccc

SEQ ID NO: 306154 - DNA, 563 bp, Homo sapiens
aaaggactcacacggatgcggaaaccgagacgggctggatggaaaactctttccagacagactccggggccctcaactggtctccgaccttcccctgcaacctgcgacacctgccattttcccatcttaggctccagaagcagaatcaagtgggatgtcttggaagaaaaacaaacaaaaggcccactaggtggagtgaaatggatcaggagcaattatgttcaatttcacctttaagttttctcaaaaggaggagcattaagaatcagccaccttagtacatacttaaagatttactgaaacctgatcctgtccccgctgatgaaacatcagaggaatgggatcctgtaggtgaagatcatcagcttataaaatcctgttgccatcaatgggggtagcaggaaaatgatgaagattggttaaggggccagtggactcagcattgaaatgaatcatggacttgaagccaaaagactcagtttgtgtcccagctctctcaagcaaagcccccaagtcccagtttcctcatctataaaaaataataaaaatacttaatggacaaa

SEQ ID NO: 306155 - DNA, 598 bp, Homo sapiens
aaaggactcacacggatgcggaaaccgagacgggctggatggaaaactctttccagacagactccggggccctcaactggtctccgaccttcccctgcaacctgcgacacctgccattttcccatcttaggctccagaagcagaatcaagtgggatgtcttggaagaaaaacaaacaaaaggcccactaggtggagtgaaatggatcaggagcaattatgttcaatttcacctttaagttttctcaaaaggaggagcattaagaatcagccaccttagtacatacttaaagaattatcctcagactttccagttttaatcttctagatttactgaaacctgatcctgtccccgctgatgaaacatcagaggaatgggatcctgtaggtgaagatcatcagcttataaaatcctgttgccatcaatgggggtagcaggaaaatgatgaagattggttaaggggccagtggactcagcattgaaatgaatcatggacttgaagccaaaagactcagtttgtgtcccagctctctcaagcaaagcccccaagtcccagtttcctcatctataaaaaataataaaaatacttaatggacaaa

SEQ ID NO: 306156 - DNA, 474 bp, Homo sapiens
ttttctcaaaaggaggagcattaagaatcagccaccttagtacatacttaaaggtaaatattacatttaagaaaatccttgttatcttaatgtggcactgagaaaatactatcaagtacagcacgtggactaagttagaacattaaatacacaggatctcttgatagaattatcctcagactttccagttttaatcttctagatttactgaaacctgatcctgtccccgctgatgaaacatcagaggaatgggatcctgtaggtgaagatcatcagcttataaaatcctgttgccatcaatgggggtagcaggaaaatgatgaagattggttaaggggccagtggactcagcattgaaatgaatcatggacttgaagccaaaagactcagtttgtgtcccagctctctcaagcaaagcccccaagtcccagtttcctcatctataaaaaataataaaaatacttaatggacaaa

SEQ ID NO: 306157 - DNA, 559 bp, Homo sapiens
aggagaaaatatttgcaagtcatctatctgataagggattaatgtacagaatatatagaacactcttcaaacaacaataaaaaaaatcaaattacccaatttaaaaataggcaaaggacttgaatggacgtttctccaagatatacaaatggttagtaagcacatgaaaagagactcaactcttttttgctagggaaatgcaacccaagaatacaacacagcaccacctcacccccattagggtggcttctatgatcagaaatcggaatccgtgggcactgttgatgggaatggaaaatggtcagccactgtggaaaacagtacggcagtgcctcaaaaacttaaaaatggaattaccgtgtaatctaataatcttatttattggcgtatatgtacagaaattgaaagaagggtcttgaagagatattcatacccccatattcagactactcttattcacaatagctggactgcagaaggaacccaagtgtctgttgatgttgaatggatacacaaaagctggtttatacatacaataaaatattattctaaaaaaaaa

SEQ ID NO: 306158 - DNA, 969 bp, Homo sapiens
tgggatgaaatcttacacatcttactttgtcccttcctcatcacaggaagaaggatgggtacagtacaataaaatattgaataaataagcaaattcaataaagtagcaggatccgaagtcaacacacaaaaaatattcattttttctattatgtgcaataacaatgaatgatctagaaaggaaatttaaaaaacaattccatttacaatagaatagcataaaaaagcataaaatacttaggaatgaatttaaccaaggagttgaaagacttatacaatgaaaactacaaaatagttctgaaagaaattaaaggagacacaaaaacctggaagacatcccatgttcacagattgaaaaaagtattgttaagatgtcaataataccgaatatgatatgcagatttaatgcaatcgttgtgaaaatccaaaagatatttctttttttgcagaaatagaaaaagctatcctaaaatttatatgaaacctcaagggaccccgattaaccaaacaatcctgaaaaataagaataaagctggagttctctcacttcttgatttcaaaaaatacatatgttacaataatcgagagagtgaggtacaaagacaaacatataaaccattggaatagaataaaagtccagaaataaagtcttgtatatatgtgtaaatgatttttgatgagtgtgtcaggatcgttcaatgaggaaaagacagtctttttaagaaatgatactgggaaaactggctatccacatgcaaaagaataaagttggacccttacctaacaccaaaaataaaaattaactcaaaatggatctatgacctaaatgtagaccaaaaactataaaactcttagaagacaacatagggcaaaaactttatgacatcagatttggcaatgatttcgtcattattacaccaaaggcatacatacgtaacaaaggaaaaaatatacaagttggactttatga

SEQ ID NO: 306159 - DNA, 295 bp, Homo sapiens
gtctcaaaaaaaataaaaattaaaaaattaaaatactaaatattcatgactgaaattatgtaaattaagtagagatgtaatttttctaaataaacattatagtatccttataccacattaataactaaaaaggcatcagaatttttaaaattcactttactggtataaatttatgggcaatcggaaaaataagactacataaacacaaaacatatcacagctcaattcaattttttgcaatttggctaagtctataaaacatattttgaacttcaagtcatctccttgcttatcc

SEQ ID NO: 306160 - DNA, 519 bp, Homo sapiens
aaaagacattcaaaaaagaaaataagaattgtgctcgaaagaattagggcacgagacagacagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaa

SEQ ID NO: 306161 - DNA, 2901 bp, Homo sapiens
tttttttgagacagggtctagctctatggcccaggctggagtgcagtggcacaatcatagctcactgcagcctcaactttctgtgctcgagtgattctcctgcctcagtctcctgagtagctgggaccacagacgtgcactaccacacttggctaattttattttttcagagatcacatgtggtttgagggaggatagagaggacagggtgtcaagaacagcatttttaccaagttgatataaaaatgaaacaggatccaggcatgggtctttacactgatagttacagtaagttttaaaatctgagcagcaatttgaatcacttcttgaaaaacacacaaaatatattttttgtagaggtgggggtcttgctctgttgcccaggctggtcttgaactcgagattctcctgctttggcctcccacaagtgctgggattacaggcgtgagctactgcacccggcctgctttctttttagtgaaaaggatctgtgggagcttttattcccatggctgccttcctcaagtcaacctctttccccggaaatggcatcatctctggactgttgtttctccttcttccttctcctccttctcctcctcctcctcctccaccatgcccggctgatttttgtatttttagtagagacagggtttcactatatgggccaggcagatctcgaactccaaacctcgtgatccacctaccttggcctctgaaagtgctgggataccgtggcctctgaaagtgctgggattacaggcatgagccaccgcgcccggccccgttgtttcccttctaagaaacgcagtggtctctgaagcctgcaggggcaggccagccctgcactgaacgcctgttcttgccaggtggcagaaggttgctgctcatttgagcagtacctgtcacccctcctcccactgctgcggctgttaactcatcttcaggtctcacaccttctgcacataaataagctatttttaaaagttattatttttttactctttcttttctttggagagggtaccaaaggatagctgttctgtttaagtagggacctctcatggcctacaggctttgacatctgagaatcaaactggagaacattccgaagccgttcttataagtgtctccatctctacctgggctgaaatggaatgtgcaaatgtagcccagcctggtccttgggtgttgccagttgattgatgactgggagccaaagtggcatctcctttgacctaaacgggcgatgatgaaataaaactcaacagcctttctctcatcttgcattgtgagatgcgaaatagagcgtgtctctctgcctctcattttaggctgaggccgtccaaagcggccatgccccatgtttccactagatggcgctgacacttcaggcatcaaccctcatggcctctcagccttgcaaaggcagccacttaaagtcggtgtcctgtgtggggcaccaagctgagctgcagacacccagtaggcgcgaggcaaatgcgtcccattttaagaggcttgtatttatgagctctttgcttcctccctcccactaactttaaagaattgctctccatctcctttggcaaagttcctttgccctttgtcttatttttgtgaaaccctccaaggtatttccagtccatttgcatccaatctggcatctttacggagagcggtctcatatgctattgttgttaacgtggactagtatttatgtgttgagaacactggctgtttgtcaggaaaagtgtgccaaaacaaagagtacggccggccctggaaatgcatcagcaaaacccatttcccccgtgcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaa

SEQ ID NO: 306162 - DNA, 2977 bp, Homo sapiens
ctagagatccccggacagggtgtcaagaacagcatttgtaccaagttgatataaaaatgaaacaggatccaggcatgggtctttacactgatagttacagtaagttttaaaatctgagcagccatttgaatcacttcctgaaaaacacaccaaatatattttttgtagaggtgggggtcttgctctgttgcccaggctgggaccacagacgtgcactaccacacttggctaattttattttttcagagatcacatgtggtttgagggaggatagagaggacagggtgtcaagaacagcatttttaccaagttgatataaaaatgaaacaggatccaggcatgggtctttacactgatagttacagtaagttttaaaatctgagcagcaatttgaatcacttcttgaaaaacacacaaaatatattttttgtagaggtgggggtcttgctctgttgcccaggctggtcttgaactcgagattctcctgctttggcctcccacaagtgctgggattacaggcgtgagctactgcacccggcctgctttctttttagtgaaaaggatctgtgggagcttttattcccatggctgccttcctcaagtcaacctctttccccggaaatggcatcatctctggactgttgtttctccttcttccttctcctccttctcctcctcctcctcctccaccatgcccggctgatttttgtatttttagtagagacagggtttcactatatgggccaggcagatctcgaactccaaacctcgtgatccacctaccttggcctctgaaagtgctgggataccgtggcctctgaaagtgctgggattacaggcatgagccaccgcgcccggccccgttgtttcccttctaagaaacgcagtggtctctgaagcctgcaggggcaggccagccctgcactgaacgcctgttcttgccaggtggcagaaggttgctgctcatttgagcagtacctgtcacccctcctcccactgctgcggctgttaactcatcttcaggtctcacaccttctgcacataaataagctatttttaaaagttattatttttttactctttcttttctttggagagggtaccaaaggatagctgttctgtttaagtagggacctctcatggcctacaggctttgacatctgagaatcaaactggagaacattccgaagccgttcttataagtgtctccatctctacctgggctgaaatggaatgtgcaaatgtagcccagcctggtccttgggtgttgccagttgattgatgactgggagccaaagtggcatctcctttgacctaaacgggcgatgatgaaataaaactcaacagcctttctctcatcttgcattgtgagatgcgaaatagagcgtgtctctctgcctctcattttaggctgaggccgtccaaagcggccatgccccatgtttccactagatggcgctgacacttcaggcatcaaccctcatggcctctcagccttgcaaaggcagccacttaaagtcggtgtcctgtgtggggcaccaagctgagctgcagacacccagtaggcgcgaggcaaatgcgtcccattttaagaggcttgtatttatgagctctttgcttcctccctcccactaactttaaagaattgctctccatctcctttggcaaagttcctttgccctttgtcttatttttgtgaaaccctccaaggtatttccagtccatttgcatccaatctggcatctttacggagagcggtctcatatgctattgttgttaacgtggactagtatttatgtgttgagaacactggctgtttgtcaggaaaagtgtgccaaaacaaagagtacggccggccctggaaatgcatcagcaaaacccatttcccccgtgcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaa

SEQ ID NO: 306163 - DNA, 2725 bp, Homo sapiens
tgtcatgagtggaaacacgcgtctcaccgtgtcacccaggacatagagcgcagtggtgtcatcttggctcattgcagcctcccaggctcaagatgatcctcccatctcaagccgtctgagatagctgagaccaagatgcacgtcaccatgcttggctaattttttaaccttttgtggagatggggtctctatattacccaagctagtctcaaactcttgggctcaagcaatcctgactcagtctcccacaagtgctgggattacaggcgtgagctactgcacccggcctgctttctttttagtgaaaaggatctgtgggagcttttattcccatggctgccttcctcaagtcaacctctttccccggaaatggcatcatctctggactgttgtttctccttcttccttctcctccttctcctcctcctcctcctccaccatgcccggctgatttttgtatttttagtagagacagggtttcactatatgggccaggcagatctcgaactccaaacctcgtgatccacctaccttggcctctgaaagtgctgggataccgtggcctctgaaagtgctgggattacaggcatgagccaccgcgcccggccccgttgtttcccttctaagaaacgcagtggtctctgaagcctgcaggggcaggccagccctgcactgaacgcctgttcttgccaggtggcagaaggttgctgctcatttgagcagtacctgtcacccctcctcccactgctgcggctgttaactcatcttcaggtctcacaccttctgcacataaataagctatttttaaaagttattatttttttactctttcttttctttggagagggtaccaaaggatagctgttctgtttaagtagggacctctcatggcctacaggctttgacatctgagaatcaaactggagaacattccgaagccgttcttataagtgtctccatctctacctgggctgaaatggaatgtgcaaatgtagcccagcctggtccttgggtgttgccagttgattgatgactgggagccaaagtggcatctcctttgacctaaacgggcgatgatgaaataaaactcaacagcctttctctcatcttgcattgtgagatgcgaaatagagcgtgtctctctgcctctcattttaggctgaggccgtccaaagcggccatgccccatgtttccactagatggcgctgacacttcaggcatcaaccctcatggcctctcagccttgcaaaggcagccacttaaagtcggtgtcctgtgtggggcaccaagctgagctgcagacacccagtaggcgcgaggcaaatgcgtcccattttaagaggcttgtatttatgagctctttgcttcctccctcccactaactttaaagaattgctctccatctcctttggcaaagttcctttgccctttgtcttatttttgtgaaaccctccaaggtatttccagtccatttgcatccaatctggcatctttacggagagcggtctcatatgctattgttgttaacgtggactagtatttatgtgttgagaacactggctgtttgtcaggaaaagtgtgccaaaacaaagagtacggccggccctggaaatgcatcagcaaaacccatttcccccgtgcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaa

SEQ ID NO: 306164 - DNA, 2764 bp, Homo sapiens
tttacttacttgattttataatcgtgtatcttttacactgatgatctctcttttttttttaatgtcacccaggctggaatgcagtggcacaatcttggttcactgcaatctccacctcccaggctcaagtgatcctcccaccccagcctcccgagtagatggcactacaggcatgtgccaccacgcctggctaatttttgtatttttagtacagacgaggtttcaccatgttgaccaggctggtcttgaactcctgatcttaagtgatctgcccgccttggcctcccaaagtgctgggattacgggcgtgagctactgcacccggcctgctttctttttagtgaaaaggatctgtgggagcttttattcccatggctgccttcctcaagtcaacctctttccccggaaatggcatcatctctggactgttgtttctccttcttccttctcctccttctcctcctcctcctcctccaccatgcccggctgatttttgtatttttagtagagacagggtttcactatatgggccaggcagatctcgaactccaaacctcgtgatccacctaccttggcctctgaaagtgctgggataccgtggcctctgaaagtgctgggattacaggcatgagccaccgcgcccggccccgttgtttcccttctaagaaacgcagtggtctctgaagcctgcaggggcaggccagccctgcactgaacgcctgttcttgccaggtggcagaaggttgctgctcatttgagcagtacctgtcacccctcctcccactgctgcggctgttaactcatcttcaggtctcacaccttctgcacataaataagctatttttaaaagttattatttttttactctttcttttctttggagagggtaccaaaggatagctgttctgtttaagtagggacctctcatggcctacaggctttgacatctgagaatcaaactggagaacattccgaagccgttcttataagtgtctccatctctacctgggctgaaatggaatgtgcaaatgtagcccagcctggtccttgggtgttgccagttgattgatgactgggagccaaagtggcatctcctttgacctaaacgggcgatgatgaaataaaactcaacagcctttctctcatcttgcattgtgagatgcgaaatagagcgtgtctctctgcctctcattttaggctgaggccgtccaaagcggccatgccccatgtttccactagatggcgctgacacttcaggcatcaaccctcatggcctctcagccttgcaaaggcagccacttaaagtcggtgtcctgtgtggggcaccaagctgagctgcagacacccagtaggcgcgaggcaaatgcgtcccattttaagaggcttgtatttatgagctctttgcttcctccctcccactaactttaaagaattgctctccatctcctttggcaaagttcctttgccctttgtcttatttttgtgaaaccctccaaggtatttccagtccatttgcatccaatctggcatctttacggagagcggtctcatatgctattgttgttaacgtggactagtatttatgtgttgagaacactggctgtttgtcaggaaaagtgtgccaaaacaaagagtacggccggccctggaaatgcatcagcaaaacccatttcccccgtgcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaa

SEQ ID NO: 306165 - DNA, 2044 bp, Homo sapiens
ttcttagggattagggaggagggttgacaggtactgctcaaagtgagcagcaccctcctcccactgctgcggctgttaactcatcttcaggtctcacaccttctgcacataaataagctatttttaaaagttattatttttttactctttcttttctttggagagggtaccaaaggatagctgttctgtttaagtagggacctctcatggcctacaggctttgacatctgagaatcaaactggagaacattccgaagccgttcttataagtgtctccatctctacctgggctgaaatggaatgtgcaaatgtagcccagcctggtccttgggtgttgccagttgattgatgactgggagccaaagtggcatctcctttgacctaaacgggcgatgatgaaataaaactcaacagcctttctctcatcttgcattgtgagatgcgaaatagagcgtgtctctctgcctctcattttaggctgaggccgtccaaagcggccatgccccatgtttccactagatggcgctgacacttcaggcatcaaccctcatggcctctcagccttgcaaaggcagccacttaaagtcggtgtcctgtgtggggcaccaagctgagctgcagacacccagtaggcgcgaggcaaatgcgtcccattttaagaggcttgtatttatgagctctttgcttcctccctcccactaactttaaagaattgctctccatctcctttggcaaagttcctttgccctttgtcttatttttgtgaaaccctccaaggtatttccagtccatttgcatccaatctggcatctttacggagagcggtctcatatgctattgttgttaacgtggactagtatttatgtgttgagaacactggctgtttgtcaggaaaagtgtgccaaaacaaagagtacggccggccctggaaatgcatcagcaaaacccatttcccccgtgcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaa

SEQ ID NO: 306166 - DNA, 1428 bp, Homo sapiens
tctagaggatctcccgggagccttaaccctcattaggccagacaccagtctggccgggtcagggaggccagccttggcgcctgtcacacgtagtccagaatctccatctcctttggcaaagttcctttgccctttgtcttatttttgtgaaaccctccaaggtatttccagtccatttgcatccaatctggcatctttacggagagcggtctcatatgctattgttgttaacgtggactagtatttatgtgttgagaacactggctgtttgtcaggaaaagtgtgccaaaacaaagagtacggccggccctggaaatgcatcagcaaaacccatttcccccgtgcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaa

SEQ ID NO: 306167 - DNA, 1421 bp, Homo sapiens
cgcacataattagtacgcacataatttgtacgcacataattagtacgcacataattagtacgcacataattagtacgcacataattagtacgcacataactatagcaccacagattcctttgccctttgtcttatttttgtgaaaccctccaaggtatttccagtccatttgcatccaatctggcatctttacggagagcggtctcatatgctattgttgttaacgtggactagtatttatgtgttgagaacactggctgtttgtcaggaaaagtgtgccaaaacaaagagtacggccggccctggaaatgcatcagcaaaacccatttcccccgtgcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaa

SEQ ID NO: 306168 - DNA, 1965 bp, Homo sapiens
agcgggcttcgcagcgtcacgccctccggggccgtggcggcgacggcggtgcgtagcttactcacaggggcggcccgtatccctccgccgccggcgcggctcggccctccctcccctggccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataa

SEQ ID NO: 306169 - DNA, 2707 bp, Homo sapiens
agcgggcttcgcagcgtcacgccctccggggccgtggcggcgacggcggtgcgtagcttactcacaggggcggcccgtatccctccgccgccggcgcggctcggccctccctcccctggccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataattttgtgtgaataggctttttcatttttaagaagtttgtctagctgagattagtggtggattttctcccacttctgaaatgttcatttatactggttgcattttaagatcatgaaacaattccagttacattgtaaaaaggatatcttacgagtaattttattgaacaagttagaggcataagcttaagagcatttccatgaaacaacacatgcagcattccaggaacttgattgttaaattcaataagaaatttgctttattaatgaaactaagctgcatttcatcaaaaccttgtgacattcccttggtacataggacataaaacacagaggcattgctatttggtaagttaagcttctgtgattgtaattataaaagagcaacattgaccaaacctgggaaacaagagcacagtcttgtttggagagtctacataattactttgcactaacatttgcaggatgttcacacaattttaaattgtactgtatgtggctttttgaagtcttcccttgaccctagtaaaatatagcttgaaacttgtaaacaactgtgtttgccagaaacatcattcatgtgaactaggcaagttaccttttttccccccttcttttcctaattgtaaactaggccaacctgaaagccatggctgatgctctagccatcaggttctttcaaatgcatctttacactcttgcacaaaagttaaggaataaatgtccactgcttttggttttaaa

SEQ ID NO: 306170 - DNA, 506 bp, Homo sapiens
tgctgggattacaggtgtgagccatcacgcccggcccataatacatgacacatgttttaccttcctgattgtatttatttgctaagctctgaacaaagcaaaaatgacccactttaaaaaaatacacattgccttgaagaatccaaaataccttaaagattcaccaatctactcatctcttactctgaaggaatgctcttaagagagtttcaccagcaggacagagaatattggtaacaatataaactttagtaatggataaaaggtacatttatgttgaatatatttcttttctttcttttttctgtaggaattggaattgaatgatctggcacgggaccctccagcacagtgttcagcaggtcctgttggagatgatagtaagtatttaaaaggaataatggagtaatagcataacagtggttattttgtgtgaagaaacaattatggtatagggaagaggcagtgtttaacccttagtggcccatgaagggagcaactctatg

SEQ ID NO: 306171 - DNA, 410 bp, Homo sapiens
ttggttccctgaccgggaagcaaggtgactgacagacggccgaggcagccccttaggcggcttaagcctgccctgtggagcatccctgtgggggactccggccagcctgagtgacgcgatccaaagagcgctcccgggtaggaaattgccctggtggaatgcctcgccagagcagcgtgtagcaggcccccgcggaggattaacacagtggctgaacaccgggaaggaactggcacttgggagtccggacatctgaaacttgctccctccacaaaaccgcctgagctcgggctgacagaggaagccgttttgcccgatccacaagtatatcctgagttcacttacctcttgggtggcagcacacatcggtccaccctgcttgtccagaaactgttaagagttggaagttc

SEQ ID NO: 306172 - DNA, 2044 bp, Homo sapiens
agcgggcttcgcagcgtcacgccctccggggccgtggcggcgacggcggtgcgtagcttactcacaggggcggcccgtatccctccgccgccggcgcggctcggccctccctcccctggccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccagtaagtattcagattaatttcagaataaacagtttatgtaatttactcattttaatcccacttttcttgttatcaacagaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataa

SEQ ID NO: 306173 - DNA, 1933 bp, Homo sapiens
agcgggcttcgcagcgtcacgccctccggggccgtggcggcgacggcggtgcgtagcttactcacaggggcggcccgtatccctccgccgccggcgcggctcggccctccctcccctggccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgataaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataa

SEQ ID NO: 306174 - DNA, 2275 bp, Homo sapiens
agcgggcttcgcagcgtcacgccctccggggccgtggcggcgacggcggtgcgtagcttactcacaggggcggcccgtatccctccgccgccggcgcggctcggccctccctcccctggccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataacaaaccaccccccccccacccaaaaccaacacacaacacagatctgatgatgatagatgaagcgagtatgagaatggaatcatgctgtatgacttcatctgctgactacactgacatgcatcaccttctatatctaactacctctaacaccatccaacacacaacaccaacacaccacccacataacaacacacacacaaccaaccatacctaatactaatactcctctcacctggctttctactctaactatatattctcatctctctcttttcttatattactccctttccctcattaataccatatc

SEQ ID NO: 306175 - DNA, 1913 bp, Homo sapiens
agcgggcttcgcagcgtcacgccctccggggccgtggcggcgacggcggtgcgtagcttactcacaggggcggcccgtatccctccgccgccggcgcggctcggccctccctcccctggccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaaaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataa

SEQ ID NO: 306176 - DNA, 1594 bp, Homo sapiens
agcgggcttcgcagcgtcacgccctccggggccgtggcggcgacggcggtgcgtagcttactcacaggggcggcccgtatccctccgccgccggcgcggctcggccctccctcccctggccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgacgtagctccttcggaataaattga

SEQ ID NO: 306177 - DNA, 1380 bp, Homo sapiens
acccgactcagcctcccaaagtgctgggattacaggtgtgagccaacatgcccagccttctgtcggtttaatcattattagtatatgagttcaagaactatgtaatgtagaatcatataatttcaagtactttaaatgaatgaattgagtggacatcttttgtagaaataggccaatcaagtatggaataaggtatatgccaacaaatactaaaatttaatcagaaccctctataagtagcaattaaaggagactttcacattttacagctccttcccattatcattgaattaatccttatcagaaatttgggatagaaaggggcctttccttgaatgtcctataagctactctcttcaagttacttgatgggataatgaatggaatctgttgcttactgactccacacctatgttaagccaagcttctctttgtgtgtacaggtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaaggtgaagaacatgaagctgtgtctgtattcattttattccgaaggagctacgtcttaggtgaaagttatgaccaaccagattaaactctacccacatcctgcattttaaggtctaagtttaactggtcaacatttaaatggattggagctattagtacatcaagtgtgatgggctttgttcccaactcttttacatctccctaccccttcaacctttggcctttcagcccttctttctctcttccatattctttggtttgtatgtggtttctcagttaatacatagctaatagctcttatttttcttatgtttttaaccgcttaggtctatttggatgtaagggtgaaaattcatttgatggaaatacttgtgtatatttaaagacccaattgctcctctggagcttgtactttcaagaatgattaatctgtgtaataaactggttactacagtcattacatataa

SEQ ID NO: 306178 - DNA, 1563 bp, Homo sapiens
agcgggcttcgcagcgtcacgccctccggggccgtggcggcgacggcggtgcgtagcttactcacaggggcggcccgtatccctccgccgccggcgcggctcggccctccctcccctggccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagactaaaagcttttcttattgacttaaatttggataacagcaaggtgtgaggggggtggtgggtatggtgtgtgcttggatgggaaagaaaaggctccactcacctataggagattatttttaagtggaatccatttaaactcaaaacagttatgaaaagcaagatgtgtccagttttcgttttctattgaatttttttttttttttttcttttttttttttttcta

SEQ ID NO: 306179 - DNA, 1362 bp, Homo sapiens
agcgggcttcgcagcgtcacgccctccggggccgtggcggcgacggcggtgcgtagcttactcacaggggcggcccgtatccctccgccgccggcgcggctcggccctccctcccctggccgccaatccccgcgcctcccgacctgcccctcggtcgggcccaccccgtgctccgacggccccaccccggcggcgcagcccgcccgcccgcgcgtccctcggtccacctgcagcagggaggaagacaggcaatccctccggctgtccgaccaagagaggccggccgagcccgaggcttgggcttttgctttctggcggagggatctgcggcggtttaggaggcggcgctgatcctgggaggaagaggcagctacggcggcggcggcggtggcggctagggcggcggcgaataaaggggccgccgccgggtgatgcggtgaccgctgcggcaggcccaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccaccatggctctgaagagaatccacaaggaattgaatgatctggcacgggaccctccagcacagtgttcagcaggtcctgttggagatgatatgttccattggcaagctacaataatggggccaaatgacagtccctatcagggtggagtatttttcttgacaattcatttcccaacagattaccccttcaaaccacctaaggttgcatttacaacaagaatttatcatccaaatattaacagtaatggcagcatttgtcttgatattctacgatcacagtggtctccagcactaactatttcaaaagtactcttgtccatctgttctctgttgtgtgatcccaatccagatgatcctttagtgcctgagattgctcggatctacaaaacagatagagaaaagtacaacagaatagctcgggaatggactcagaagtatgcgatgtaattaaagaaattattggataacctctacaaataaagataggggaactctgaaagagaaagtccttttgatttccatttgactgctttctatgagcccacgcctcatcttcccctgtgcacatgtttacctgatacagcagtgctgcgtgttgtacatacttggaacaacaaactagaaatactgtacttctgtaccaacattgcctcctagcagagaagtgtgtgtgtgacaagccagttctacaggcattacctaggtgtgagcagcttgggagatcctgcagagtcg

SEQ ID NO: 306180 - DNA, 346 bp, Homo sapiens
ccacctcggcctcccaaagtgctgggattacaggcatgagccaccgcacccagcctagatattgttacatatatacattcaaagttctaataacatcatgccccggagtatatggctaagaaaagctaatagttaaacacacaaacatacacatgcagagaagcaaaagttatcaagtttttggtttttgtttttttcctgttttgggacaggatctggctctgtcacccaggctgcagtgcagtggtgccatctcagctcaatgcaacatacacctcccaagtcaaggatcctcccacctcagcttcccaagtagctgggactacaggtacacaccaccacaccc

SEQ ID NO: 306181 - DNA, 2481 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgcttttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatccgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcg

SEQ ID NO: 306182 - DNA, 1178 bp, Homo sapiens
ggtaatgagaacatgggggacatattgaaaggacacaggaaccaaattgaatgtccctcagtggccaaatcttgggcaatttgagcaataaaataatgacaataatgggttatagtccactgactaaaaatacactatagaatcccatacacaatggaatcacaaatgtagaaggaacgatagaaatagaaaaaatggctgggtgcagtggctcacgcctgtagtcccagcactttgggaggccaaggcgggtggatcatctggggtcaggagttcaagaccagcctggccaacatgatgaaaccctgtctctactaaaaatacacaaagttagccaggcgtggtggcacgtgcctgtaatcccagctactccggaggctgaggcaggagaatcgcttgaacagggaggtggaggttgcagtgatccgggactgtgccactgccctctagcctgggtgacagagtgagactccatctcaaacccacaaacaaaaaaacaccattaggcaaacaccataggaatagttgttgcagacaagaaacacctatgaatgccgaattagtgaacagaagtatgatgggaaacacgattttgcatggttttaagatcccttcacaagatactaattacaaagggaaaaacagtcattatagtgaataagcctgacagaaaccaccttaacccagtgatcaagttaacatcaccactaataagacatactgataccatgtaccttccaatatgatgcactgagaagggcacaattgtcacttctgtggtgttgtcagaaatgtgcaatctcagtgcaatcaggagaaaagatcagacaagcccaaactgagagacactctacaaaataactggccagtacgttttgaaagtgccaaggccgtgaacaataaggaaagactgaggaacagtcatggactggaagagagtaaagaaatatgataactaactgcattgtgagataccgatttagatgttggattagaaaaaggaccagaaataagatttcatcaatgtcaattatttggttttgataattgtactgtggttatgtaagatgttaacattagtaagagctgggtgaagggtacatggaaactattatttttgccaccctttgaaagtctaacttttttcaaaataaaaagttttaaaaataaaaaaagaa

SEQ ID NO: 306183 - DNA, 1037 bp, Homo sapiens
aggatcccaaacagtccaagcagaaacataaatccattccttgcagactaagatatgggcacaagactacacatttatatctttagacatgatatctcataccagaacactcatcatcattatgcgactgccattgaatatcaaatcaggcatctcaaccatatagtaagtaaaagagaattctatatctgcatcctgccaatcctgcttctttcccagtaatttaacactcagtaatatgagccattatacatctatattctaaagcttcacaacatggagtcattaccagctgtattatatacaccattccaagcctatataatagacaaacagttagtgttcttactatataaggaattaaaaattaagggacaaaggaccaaaaacttgatagaaaaactgggaaaagacatgaacatactcacgtaaagatataaaaatggctctttaaaatgaaatattcaaactaactcattagagaaatgtaaattgagataatactgagataccatttatcatctctaagactggtgaaagaaagaacaacacatttctgttaggcaaggctatagggaaacacactgtcatcactgttggtaggaatgcaaactggtatgacttctggaggggaatttgtcagtacttaacaaattgcagaagcatttaccctttgacacaaccatttccactgtgggaatttcccttgaagatgcacctccaacagtacaaacatacagatgcacaagattactcattgcagcactgagactgcaaatattggaagcaaagtcatgttcatatacacgagaaagcctgagtaaaccatggcaccaatggcatacccacatgatggaatattattgagctataaaaaaaatgaggaagatctctatgaatcggtatagttattttcaagatatattaaatgcaaaaagcaaagtacaaaaagtagaaagtggtactttgtatgtaagaaagaaggagatgtaagaaagcacatgtatctatttgtttatgcaaagtaaataaggaaa

SEQ ID NO: 306184 - DNA, 4384 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgcttttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatccgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcgcagtttccccttgccttggctgcatatttcactgatcacatctcaggatttcaaaagcatttttggggtggggctcttttggttggaagggtttgttggaacggtacaggtgagccgaggtgattccagggacggacccttctgcaggagcttgagcttgcttgttgtctctgcttcatcgccatccagctcccttgtttgctattttgctttccatcacatcatgactgcggagagcaaaaatcacctagtgaccattgaacaggtcccagagacaaaatctttttatctgaggaatttaaaagggagcaaagaccacctggtgactatcaggccatgcagaggcaaaacgccttatttggggaaaattaaaagtaattagactttcctattatctaaagcaggcatctggttccagatttcttttccccgaaaaaaaccttagaagtaactaaaatttctgtacatctccggaatgccatgctgaaactcactgcaaccccacggtcccgctttaaggtccataaatatccctaaggaaaaatccaccgtggtacattcagtcctctcaccgaggtgccccatggcagtcttctgcagcattcttctaatacctttcctttttcaaacctatactgttgttggtgaattctttttaccaacccacgagttgaccacttcccaatgccggggatctgacacctcacctggcaatgacctccacagccgtttccctctgttggatcttccagccttattctcaacagttcatttttagttcacattcttgaccgaatctcagtagctcagttaatctttttatgtctgctctgctcttgggtcatatgttccgtgaggtttcttaggggtgggggatgaggagttaaaggtggcatcttcaatcgcaggtcaaagcagactttaataaatggtgctgagccaactggaaagccccttggagaaagttgaagttagacctgtacttcacaccatatgcaagaatgaactccatctggatccaggatccaaatgtaagaaaatgaagccatataaatacagaaggaaacgtggtggaaatatccagtggcaacaaaatattgacacatttgactacatgaagataataaaaatgcttagtaaaaacacaataaaatcaaatgactgggagaaaaatttatccagcctatataatagacaaacagttagtgttcttactatataaggaattaaaaattaagggacaaaggaccaaaaacttgatagaaaaactgggaaaagacatgaacatactcacgtaaagatataaaaatggctctttaaaatgaaatattcaaactaactcattagagaaatgtaaattgagataatactgagataccatttatcatctctaagactggtgaaagaaagaacaacacatttctgttaggcaaggctatagggaaacacactgtcatcactgttggtaggaatgcaaactggtatgacttctggaggggaatttgtcagtacttaacaaattgcagaagcatttaccctttgacacaaccatttccactgtgggaatttcccttgaagatgcacctccaacagtacaaacatacagatgcacaagattactcattgcagcactgagactgcaaatattggaagcaaagtcatgttcatatacacgagaaagcctgagtaaaccatggcaccaatggcatacccacatgatggaatattattgagctataaaaaaaatgaggaagatctctatgaatcggtatagttattttcaagatatattaaatgcaaaaagcaaagtacaaaaagtagaaagtggtactttgtatgtaagaaagaaggagatgtaagaaagcacatgtatctatttgtttatgcaaagtaaataaggaaa

SEQ ID NO: 306185 - DNA, 2145 bp, Homo sapiens
  misc_feature (1494)..(1494): n is a, c, g, or t
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgcttttttttttttttgagacagaatctcactttgtcaccaggctggagtgcagtggtgcaatctcacctcactgcaacctccgcctcctgagnaaggagaatcgcttgaacagggaggtggaggttgcagtgatccgggactgtgccactgccctccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcg

SEQ ID NO: 306186 - DNA, 2952 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgcttttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatccgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcgaaaaaaataaaagaaaaaaaagaaagaaaaaaaaaaaaaaaaaaaaagacaagaaggaggaaaaacacggagcgagaaagagagccgcgggagcacaagaggggcaatgagagacaaacagcagcggcagcgaccagagagaggagctaaaaaaacgagcgaagaagaagaggaggggaagaaggagcacagagaggagaagggccgagatagaccacagggaagaaaaataggcagaagagggagaaaagaggcgacacaaaagagagaaaggacaacaaacgaggggacagagacaagcacgagcaaggagagagagtgagaaagcggaagtgtgatggacaacacgaacagagagcgacgtaaaaacgcggagacagaaaaagaggcaataaaggagcgccacaacggagcagacaacaacagggaggagaaaaaacaacgaggagaggggacacacaggagaaccaa

SEQ ID NO: 306187 - DNA, 2701 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgcttttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatccgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcgacacaaaacacacaccacccacacccacccacacaatcacacccccgccacgcccacccccccacaccacccccacaccacaaccagcgccaccacacccaccaccacaccaagcacagccgcgcaccacacaacacaccccgcaccaacccacacacacacgccccccccccccccagccaccaccgaggacggcaccccacacacacacgcccaccac

SEQ ID NO: 306188 - DNA, 2632 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgcttttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatccgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcgaagaagaagcaaaagagcgaaaaaaaaaagacacaagaaagacacaaaaagacaaacaaagagaggggtgacacacaaaactcaccagagggggacaagaaagaaggagacaccgaatgtacaacgaagggcccaacaaagatacgacaag

SEQ ID NO: 306189 - DNA, 4424 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgcttttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatccgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgatccccacagctcacaggtgagaggctgctcatacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcgcagtttccccttgccttggctgcatatttcactgatcacatctcaggatttcaaaagcatttttggggtggggctcttttggttggaagggtttgttggaacggtacaggtgagccgaggtgattccagggacggacccttctgcaggagcttgagcttgcttgttgtctctgcttcatcgccatccagctcccttgtttgctattttgctttccatcacatcatgactgcggagagcaaaaatcacctagtgaccattgaacaggtcccagagacaaaatctttttatctgaggaatttaaaagggagcaaagaccacctggtgactatcaggccatgcagaggcaaaacgccttatttggggaaaattaaaagtaattagactttcctattatctaaagcaggcatctggttccagatttcttttccccgaaaaaaaccttagaagtaactaaaatttctgtacatctccggaatgccatgctgaaactcactgcaaccccacggtcccgctttaaggtccataaatatccctaaggaaaaatccaccgtggtacattcagtcctctcaccgaggtgccccatggcagtcttctgcagcattcttctaatacctttcctttttcaaacctatactgttgttggtgaattctttttaccaacccacgagttgaccacttcccaatgccggggatctgacacctcacctggcaatgacctccacagccgtttccctctgttggatcttccagccttattctcaacagttcatttttagttcacattcttgaccgaatctcagtagctcagttaatctttttatgtctgctctgctcttgggtcatatgttccgtgaggtttcttaggggtgggggatgaggagttaaaggtggcatcttcaatcgcaggtcaaagcagactttaataaatggtgctgagccaactggaaagccccttggagaaagttgaagttagacctgtacttcacaccatatgcaagaatgaactccatctggatccaggatccaaatgtaagaaaatgaagccatataaatacagaaggaaacgtggtggaaatatccagtggcaacaaaatattgacacatttgactacatgaagataataaaaatgcttagtaaaaacacaataaaatcaaatgactgggagaaaaatttatccagcctatataatagacaaacagttagtgttcttactatataaggaattaaaaattaagggacaaaggaccaaaaacttgatagaaaaactgggaaaagacatgaacatactcacgtaaagatataaaaatggctctttaaaatgaaatattcaaactaactcattagagaaatgtaaattgagataatactgagataccatttatcatctctaagactggtgaaagaaagaacaacacatttctgttaggcaaggctatagggaaacacactgtcatcactgttggtaggaatgcaaactggtatgacttctggaggggaatttgtcagtacttaacaaattgcagaagcatttaccctttgacacaaccatttccactgtgggaatttcccttgaagatgcacctccaacagtacaaacatacagatgcacaagattactcattgcagcactgagactgcaaatattggaagcaaagtcatgttcatatacacgagaaagcctgagtaaaccatggcaccaatggcatacccacatgatggaatattattgagctataaaaaaaatgaggaagatctctatgaatcggtatagttattttcaagatatattaaatgcaaaaagcaaagtacaaaaagtagaaagtggtactttgtatgtaagaaagaaggagatgtaagaaagcacatgtatctatttgtttatgcaaagtaaataaggaaa

SEQ ID NO: 306190 - DNA, 2212 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgcttttttttttttttgagacagaatctcactttgtcaccaggtggaggttgcagtgatccgggactgtgccactgccctctagcctgggtgacagagtgagactccatctcaaacccacaaacaaaaaaacaccattaggcaaacaccataggaatagttgttgcagacaagaaacacctatgaatgccgaattagtgaacagaagtatgatgggaaacacgattttgcatggttttaagatcccttcacaagatactaattacaaagggaaaaacagtcattatagtgaataagcctgacagaaaccaccttaacccagtgatcaagttaacatcaccactaataagacatactgataccatgtaccttccaatatgatgcactgagaagggcacaattgtcacttctgtggtgttgtcagaaatgtgcaatctcagtgcaatcaggagaaaagatcagacaagcccaaactgagagacactctacaaaataactggccagtacgttttgaaagtgccaaggccgtgaacaataaggaaagactgaggaacagtcatggactggaagagagtaaagaaatatgataactaactgcattgtgagataccgatttagatgttggattagaaaaaggaccagaaataagatttcatcaatgtcaattatttggttttgataattgtactgtggttatgtaagatgttaacattagtaagagctgggtgaagggtacatggaaactattatttttgccaccctttgaaagtctaacttttttcaaaataaaaagttttaaaaataaaaaaagaa

SEQ ID NO: 306191 - DNA, 2521 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgcttttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatccgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgatccccacagctcacaggtgagaggctgctcatacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcg

SEQ ID NO: 306192 - DNA, 2058 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagaactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcgaagaagaagcaaaagagcgaaaaaaaaaagacacaagaaagacacaaaaagacaaacaaagagaggggtgacacacaaaactcaccagagggggacaagaaagaaggagacaccgaatgtacaacgaagggcccaacaaagatacgacaag

SEQ ID NO: 306193 - DNA, 2518 bp, Homo sapiens
ctgcagaggaggctgccggcagtacaggatgcagggagaacccaggcctggggttgaggccaggagactcaattccagctttactgtgtgcctttagcaggaatgtcatgggtagaagctgctggcgtgtcatctacagccttggaggacaggattgtggccaagcatgaggaggttccagaagtttcagttcagtatgaagaaaaatttcagaaccatcacaaactgccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcgcttttttttttttttgagacagaatctcactttgtcaccaggctggagtgcagtggtgcaatctcacctcactgcaacctccgcctcctgggttcaagcaattctcctgcctcagcctcccaagtagcttggactacaggccctgccaccacgcccggctaatttgtgtatttttagtagagatggggtttcaccatgttggccaggatggtctcgatctcttgacctcgtgatccgtccaccttggccttgcaaagcgctggattacaggcatgagccactacacccagccgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcg

SEQ ID NO: 306194 - DNA, 1751 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtgaggaaggtcccttttcctctgttttgtgtttgccaaggccaaactcccactctctgcccccctttaatcccctttctacagtgagtccactaccctcactgaaaatcattttgtaccacttacattttaggctggggcaagcagccctgacctaagggagaatgagttggacagttcttgatagcccagggcatctgctgggctgaccacgttactcatccccgttaacattctctctaaagagcctcgttcatttccaaagcagttaaggaatgggaaccagagtgttttaggacctgaagaatctttatgactctctctctttcactctttttttttttggtcactaagttaaaagcgaagtgagagtattaacgtttttgttctcctccggccccctgttacaatgaaggggcaaaagtatttgctcttagtctattcctcccttaacttctgtgactaatttttatttcctttctagatttgcccaattaatactagggtgcagtgtatcctggagaggtagggtgtgtgggggaggaatcccttgggggagatattaggagtgctctgttgtttacaaactcaggtacccgcagggcctagcaagagacttaaatgactgataagaaccgtgagaaacatgttgcttccaggcttgatttcgatttttcctttttgattaaagatgctattacaatgtaaatatttcttacacagaaagtcacagcacatgtgcccattgatacaaggctgctgaggcctggtctccagttggaaatataattaagggtggcaaggactggagtcagttggagagtgcatagccagtctgtgaagacaactgccagatactggcaatactccagcctggtgacagagtgagactctgtctcaaaaaaaaaaaaagattcatgtccttagattagattgtaacgcactgggcaggtactgtgtctaatgttttgtgtggcacctgtcacattgttagagctcaataaacgttcaacaacaaaaaaaaaaaa

SEQ ID NO: 306195 - DNA, 681 bp, Homo sapiens
gaatcgagctggtccgtctcgccacaggactggagtcagttggagagtgcatagccagtctgtgaagacaactgccagatactggcaatactccagcctggtgacagagtgagactctgtctcaaaaaaaaagtttcaatgtttactcctagagaagccaaaaatccagatttgtatatgaaatcttaccattttaaaagattggcagctaattatttttttaaaaagctgtgcagtgtgatgtgtcccaaacggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcg

SEQ ID NO: 306196 - DNA, 2363 bp, Homo sapiens
  misc_feature (1)..(1): n is a, c, g, or t
ntgatatagagctcggtaccgtcagcccacaaggactggctcatgggtggccacgtcacaacctctgatctcagaccgtgcatgccttgtcctcttaagacaactcctgtggcaccgtttctccctccacagggccaaagccatagtgtccggtcccaaggacaaggctcttccagtgctaggagaggtatgagcagcctctcacctgtgagctgtggggatcacaaggctgcctgcctcagtcttggagtcctgttgggtgaatgaggcagatgggaaagagcctcaccagcagctgcttttggagcaggggtccaaggaagagagggtggcctcgacatcaaactgcctggatttttctaccaccctgttacatcataacaacttctgaaacacacaccagccctgagttctgggctcatttgaagcctggaatagcaataaatctttttaacttgcgcagtttccccttgccttggctgcatatttcactgatcacatctcaggatttcaaaagcatttttggggtggggctcttttggttggaagggtttgttggaacggtacaggtgagccgaggtgattccagggacggacccttctgcaggagcttgagcttgcttgttgtctctgcttcatcgccatccagctcccttgtttgctattttgctttccatcacatcatgactgcggagagcaaaaatcacctagtgaccattgaacaggtcccagagacaaaatctttttatctgaggaatttaaaagggagcaaagaccacctggtgactatcaggccatgcagaggcaaaacgccttatttggggaaaattaaaagtaattagactttcctattatctaaagcaggcatctggttccagatttcttttccccgaaaaaaaccttagaagtaactaaaatttctgtacatctccggaatgccatgctgaaactcactgcaaccccacggtcccgctttaaggtccataaatatccctaaggaaaaatccaccgtggtacattcagtcctctcaccgaggtgccccatggcagtcttctgcagcattcttctaatacctttcctttttcaaacctatactgttgttggtgaattctttttaccaacccacgagttgaccacttcccaatgccggggatctgacacctcacctggcaatgacctccacagccgtttccctctgttggatcttccagccttattctcaacagttcatttttagttcacattcttgaccgaatctcagtagctcagttaatctttttatgtctgctctgctcttgggtcatatgttccgtgaggtttcttaggggtgggggatgaggagttaaaggtggcatcttcaatcgcaggtcaaagcagactttaataaatggtgctgagccaactggaaagccccttggagaaagttgaagttagacctgtacttcacaccatatgcaagaatgaactccatctggatccaggatccaaatgtaagaaaatgaagccatataaatacagaaggaaacgtggtggaaatatccagtggcaacaaaatattgacacatttgactacatgaagataataaaaatgcttagtaaaaacacaataaaatcaaatgactgggagaaaaatttatccagcctatataatagacaaacagttagtgttcttactatataaggaattaaaaattaagggacaaaggaccaaaaacttgatagaaaaactgggaaaagacatgaacatactcacgtaaagatataaaaatggctctttaaaatgaaatattcaaactaactcattagagaaatgtaaattgagataatactgagataccatttatcatctctaagactggtgaaagaaagaacaacacatttctgttaggcaaggctatagggaaacacactgtcatcactgttggtaggaatgcaaactggtatgacttctggaggggaatttgtcagtacttaacaaattgcagaagcatttaccctttgacacaaccatttccactgtgggaatttcccttgaagatgcacctccaacagtacaaacatacagatgcacaagattactcattgcagcactgagactgcaaatattggaagcaaagtcatgttcatatacacgagaaagcctgagtaaaccatggcaccaatggcatacccacatgatggaatattattgagctataaaaaaaatgaggaagatctctatgaatcggtatagttattttcaagatatattaaatgcaaaaagcaaagtacaaaaagtagaaagtggtactttgtatgtaagaaagaaggagatgtaagaaagcacatgtatctatttgtttatgcaaagtaaataaggaaa

SEQ ID NO: 306197 - DNA, 1718 bp, Homo sapiens
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaaggaacctactcactgcccaagagcgaattcgttgtgcctgacctggagctgcccagttggctcaccaccgggaactaccgcatagagagcgtcctgagcagcagtgggaagcgtctgggctgcatcaagatcgctgcctctctaaagggcatataacatggcatctgccacagcagaatggagcggtgtcaaagcagactttaataaatggtgctgagccaactggaaagccccttggagaaagttgaagttagacctgtacttcacaccatatgcaagaatgaactccatctggatccaggatccaaatgtaagaaaatgaagccatataaatacagaaggaaacgtggtggaaatatccagtggcaacaaaatattgacacatttgactacatgaagataataaaaatgcttagtaaaaacacaataaaatcaaatgactgggagaaaaatttatccagcctatataatagacaaacagttagtgttcttactatataaggaattaaaaattaagggacaaaggaccaaaaacttgatagaaaaactgggaaaagacatgaacatactcacgtaaagatataaaaatggctctttaaaatgaaatattcaaactaactcattagagaaatgtaaattgagataatactgagataccatttatcatctctaagactggtgaaagaaagaacaacacatttctgttaggcaaggctatagggaaacacactgtcatcactgttggtaggaatgcaaactggtatgacttctggaggggaatttgtcagtacttaacaaattgcagaagcatttaccctttgacacaaccatttccactgtgggaatttcccttgaagatgcacctccaacagtacaaacatacagatgcacaagattactcattgcagcactgagactgcaaatattggaagcaaagtcatgttcatatacacgagaaagcctgagtaaaccatggcaccaatggcatacccacatgatggaatattattgagctataaaaaaaatgaggaagatctctatgaatcggtatagttattttcaagatatattaaatgcaaaaagcaaagtacaaaaagtagaaagtggtactttgtatgtaagaaagaaggagatgtaagaaagcacatgtatctatttgtttatgcaaagtaaataaggaaa

SEQ ID NO: 306198 - DNA, 883 bp, Homo sapiens
  misc_feature (798)..(798): n is a, c, g, or t
  misc_feature (842)..(842): n is a, c, g, or t
  misc_feature (879)..(879): n is a, c, g, or t
  misc_feature (881)..(882): n is a, c, g, or t
tgccagtgactggactcagcttctttgcgtaaccaatactggaaggcatttaaaggcacctctgccgccacagaccttgcagttaactccgccctgacccacccttcccgatgcagtccctgatgcaggctcccctcctgatcgccctgggcttgcttctcgcggcccctgcgcaagcccacctgaaaaagccatcccagctcagtagcttttcctgggataactgtgatgaagggaaggaccctgcggtgatcagaagcctgactctggagcctgaccccatcgtcgttcctggaaatgtgaccctcagtgtcgtgggcagcaccagtgtccccctgagttctcctctgaaggtggatttagttttggagaaggaggtggctggcctctggatcaagatcccatgcacagactacattggcagctgtacctttgaacacttctgtgatgtgcttgacatgttaattcctactggggagccctgcccagagcccctgcgtacctatgggcttccttgccactgtcccttcaaagaagtaagtacttagggaggagagagcgttacccctgtggctaaagagatggggtttggagagaagggtctttgcattctccttctgcagatctgcatgtctctggatttgtaagccagtgtgacctatcaggaatcacttatcttccgggagcctcagttatccatctacgaaatgggagacttgaacttagatgtgatcttcagggccctttatccataataatccatgctctacagtgctatggccgtctctcatcttgtgnggctgttttgagaatgggaagaggggtggtagttcatggctgcnatcctagcagtggctctaggagaaagaccccatcagnannt

SEQ ID NO: 306199 - DNA, 531 bp, Homo sapiens
ctgcagaggaggctgccggcagtacaggatgcagggagaacccaggcctggggttgaggccaggagactcaattccagctttactgtgtgcctttagcaggaatgtcatgggtagaagctgctggcgtgtcatctacagccttggaggacaggattgtggccaagcatgaggaggttccagaagtttcagttcagtatgaagaaaaatttcagaaccatcacaaactgatgaggaaactgaggcatggagaagccaagccactcttaaggtcacttaatggatcttccatgtagtcaggactgaaccagcatccaacccagagcccggtgtggtcgacccacaaatgtttgccaagttagccatgcccttgttgtctactggttgatttcagaattacccaagcctgcaccagcctcttccttatcattcacttctgtcacctggcttgctacatggatgtgctcatgaagggctgctgaatgactgacccaccaagtacctgtcacctgaggcccagctttggcagctgt

SEQ ID NO: 306200 - DNA, 519 bp, Homo sapiens
aggaccctgcggtgatcagaagcctgactctggagcctgaccccatcgtcgttcctggaaatgtgaccctcagtgtcgtgggcagcaccagtgtccccctgagttctcctctgaaggtgagcctgggggtgggtggagaaggggaggtgcgagggtctggccagcaggggtactggggcatgtatgcttggggaactgtgaagaatttcagaatcctggattcccagagaatagtacaggacatgtagattcagacactctttcacaggttcatggaatctcaggatcataagattgaaaggaatctctgatgtcagcgccagcaacttcctggtgagggcaggagtgacggataccttgcacctggcagaagcgtcctggccttctctgggcctggtggccaactgctcattattgtctgacagctctggttggccaatttggttttgttgttaattataaaattgatataccaattagccagtaatatatagtcactttagaaaacacaagtggtca

SEQ ID NO: 306201 - DNA, 2030 bp, Homo sapiens
ctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggaagatatccaacacttggctcagcactggctggtttacaatgacaattgcactggagctctgtgacaggatcaatgtttatggcatggtgcccccagacttctgcagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgtaaggaaaaattccggaattaatgcatcctaatgaatgttgtccccttcaatggtgttaccttaggagctgaacattcaattcagttacaccactatgactaaaaacagtttggatctcttagtattgcctttgaaactgcaacataagcaactcaacaatattagttgcattcctttatagacataccatgtcaaagacgtttttctatcaagttgtattctttcctgttctataacctttgtcatctgttagactctgtatgtgtgatttgtaaaaagcaggctgaaactatggacatgatttctgaagagcacatctccactgactttcataaagcaaatgtccaatatttatttattgagagttttttagtgcaatctgggccagtatttttatagattatgattatgtggtaatttatccttcctaactctttaatcctgaatgatggttggaaatggcctagaattaggttactctgttcacaatgctcattgttagcatgcaattggtatttgacttggaagtgttgtgttgtattttttgaacccctaggcttcaggaaaactgctcttttgtaaaaagaatagcgatgacattttctaatgtgcagaaatgttccaaaaggacaaaattgaaaaccaaaaactatgttattaaaacaaaaaaatgct

SEQ ID NO: 306202 - DNA, 3707 bp, Homo sapiens
ctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggaagatatccaacacttggctcagcactggctggtttacaatgacaattgcactggagctctgtgacaggatcaatgtttatggcatggtgcccccagacttctgcagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgtaaggaaaaattccggaattaatgcatcctaatgaatgttgtccccttcaatggtgttaccttaggagctgaacattcaattcagttacaccactatgactaaaaacagtttggatctcttagtattgcctttgaaactgcaacataagcaactcaacaatattagttgcattcctttatagacataccatgtcaaagacgtttttctatcaagttgtattctttcctgttctataacctttgtcatctgttagactctgtatgtgtgatttgtaaaaagcaggctgaaactatggacatgatttctgaagagcacatctccactgactttcataaagcaaatgtccaatatttatttattgagagttttttagtgcaatctgggccagtatttttatagattatgattatgtggtaatttatccttcctaactctttaatcctgaatgatggttggaaatggcctagaattaggttactctgttcacaatgctcattgttagcatgcaattggtatttgacttggaagtgttgtgttgtattttttgaacccctaggcttcaggaaaactgctcttttgtaaaaagaatagcgatgacattttctaatgtgcagaaatgttccaaaaggacaaaattgaaaaccaaaaactatgttattaaaacaaaaaaatgctaacaagagaaatttaaaggtagttttctttagtaataatttatgtaagtgtcctctcttgagccctagtttcctttttggcagaatgatgtcactgtaccagacaacctcttaggtttcatcccaaatctaaacttgtggcctcttcttgacccatttgaagactctgcacttggagtgatggggccccaacagtagcaggaactttattttggggagccttatctacattcatattacttatatcactcttgtgggttaaaactacacttcttcctgtgtccacatggggctaaaatctaccccctggcttctctcggaaggcatcaccatccgccttcttccccagcctcttcaacacaaaaacacaggatacacacacacacacacacaaaagacatagctccaaggggttccctggctacaatagcaaacagctgcccttctgtgaggaaaagagactacaaggacatgccctatcattcaactcatttatgctatgaactgtttagactcactacaaatcttcttagattatattcattaccattccctggtctgaaggagtataaaggacttattttattcagagccaagataaattcatattatagatttttatttaaacaagtaatattgttcaaaaatagtctcttataaatatactagtgttttctttacacatgacttagaaggcattagtttctctaatgccaaatttgaaggcaccagcaaatattatgtatgaagactgacattgttttacagacatgacctggcttatgataaaagaagttttatcgcattaccacttcttttcccttttcttaattagtacactaactagtactattaattacacggagtattgttgttaaaatgcaaacacaatcagggtactcacataacataaacaaagttgatattgatgtgtatggcttgggctgttcaaagccagtaagattgaaatggccgtccaaaacatactggaatatgttctttaagttttctcatagtttttaaagggactatgaattttattccaacacattgtcttccacagcatggactctgaacacatcatactttatcaacatatgaaaaagtgtattaattttatacaatttacttataggccacctttataatcacttgaagacgttatgttgctcaaacataagtggctcctttggcaatttctatatttgtggaaatttggaaaggcatagtttcaacatgcaagaatgtaattatattgcttcatctaataatatctcacatatctgtctatcttcagattttagattttctttattaaaaaaaccatcatggtagctccatctcgtttgtaacttctccctctcaaatactcagaagaatgaagaggccaaattcagaaaatcatggcttcactgggaaatgttttaaatctacatgtagctaggatatgtgatttcatattttttaaaaatgtggtgtaaataagtgtaaaaaattaccacttgcaaagtggttttattacagcgttaaagaaaatgactagaattctgatagattgtgctgatgaacctggttgtgggcaattgaattcttgtcttcccactaccatttcatgactgtcgtctgaacactattcaacaccattaaatataaactctgatataaaagatgactacag

SEQ ID NO: 306203 - DNA, 3339 bp, Homo sapiens
gcagtgcgtgagggaagagcagagtcatagactctcctcagactatcttattgacggacaagttacagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggaagatatccaacacttggctcagcactggctggtttacaatgacaattgcactggagctctgtgacaggatcaatgtttatggcatggtgcccccagacttctgcagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgtaaggaaaaattccggaattaatgcatcctaatgaatgttgtccccttcaatggtgttaccttaggagctgaacattcaattcagttacaccactatgactaaaaacagtttggatctcttagtattgcctttgaaactgcaacataagcaactcaacaatattagttgcattcctttatagacataccatgtcaaagacgtttttctatcaagttgtattctttcctgttctataacctttgtcatctgttagactctgtatgtgtgatttgtaaaaagcaggctgaaactatggacatgatttctgaagagcacatctccactgactttcataaagcaaatgtccaatatttatttattgagagttttttagtgcaatctgggccagtatttttatagattatgattatgtggtaatttatccttcctaactctttaatcctgaatgatggttggaaatggcctagaattaggttactctgttcacaatgctcattgttagcatgcaattggtatttgacttggaagtgttgtgttgtattttttgaacccctaggcttcaggaaaactgctcttttgtaaaaagaatagcgatgacattttctaatgtgcagaaatgttccaaaaggacaaaattgaaaaccaaaaactatgttattaaaacaaaaaaatgctaacaagagaaatttaaaggtagttttctttagtaataatttatgtaagtgtcctctcttgagccctagtttcctttttggcagaatgatgtcactgtaccagacaacctcttaggtttcatcccaaatctaaacttgtggcctcttcttgacccatttgaagactctgcacttggagtgatggggccccaacagtagcaggaactttattttggggagccttatctacattcatattacttatatcactcttgtgggttaaaactacacttcttcctgtgtccacatggggctaaaatctaccccctggcttctctcggaaggcatcaccatccgccttcttccccagcctcttcaacacaaaaacacaggatacacacacacacacacacaaaagacatagctccaaggggttccctggctacaatagcaaacagctgcccttctgtgaggaaaagagactacaaggacatgccctatcattcaactcatttatgctatgaactgtttagactcactacaaatcttcttagattatattcattaccattccctggtctgaaggagtataaaggacttattttattcagagccaagataaattcatattatagatttttatttaaacaagtaatattgttcaaaaatagtctcttataaatatactagtgttttctttacacatgacttagaaggcattagtttctctaatgccaaatttgaaggcaccagcaaatattatgtatgaagactgacattgttttacagacatgacctggcttatgataaaagaagttttatcgcattaccacttcttttcccttttcttaattagtacactaactagtactattaattacacggagtattgttgttaaaatgcaaacacaatcagggtactcacataacataaacaaagttgatattgatgtgtatggcttgggctgttcaaagccagtaagattgaaatggccgtccaaaacatactggaatatgttctttaagttttctcatagtttttaaagggactatgaattttattccaacacattgtcttccacagcatggactctgaacacatcatactttatcaacatatgaaaaagtgtattaattttatacaatttacttataggccacctttataatcacttgaagacgttatgttgctcaaacataagtggctcctttggcaatttctatatttgtggaaatttggaaaggcatagtttcaacatgcaagaatgtaattatattgcttcatctaataatatctcacatatctgtctatcttcagattttagattttctttattaaaaaaaccatcatggtagctccatctcgtttgtaacttctccctctcaaatactcagaagaatgaagaggccaaattcagaaaatcatggcttcactgggaaatgttttaaatctacatgtagctaggatatgtgatttcatattttttaaaaatgtggtgtaaataagtgtaaaaaattaccacttgcaaagtggttttattacagcgttaaagaaaatgactagaattctgatagattgtgctgatgaacctggttgtgggcaattgaattcttgtcttcccactaccatttcatgactgtcgtctgaacactattcaacaccattaaatataaactctgatataaaagatgactacag

SEQ ID NO: 306204 - DNA, 1410 bp, Homo sapiens
gagagggctaaacaaacttacagaatcccaaccatgtataagaagaccaccactgcctcccccaggactccaggtaccaagcgataacactgtctaagcacaggatacacacacacacacacacaaaagacatagctccaaggggttccctggctacaatagcaaacagctgcccttctgtgaggaaaagagactacaaggacatgccctatcattcaactcatttatgctatgaactgtttagactcactacaaatcttcttagattatattcattaccattccctggtctgaaggagtataaaggacttattttattcagagccaagataaattcatattatagatttttatttaaacaagtaatattgttcaaaaatagtctcttataaatatactagtgttttctttacacatgacttagaaggcattagtttctctaatgccaaatttgaaggcaccagcaaatattatgtatgaagactgacattgttttacagacatgacctggcttatgataaaagaagttttatcgcattaccacttcttttcccttttcttaattagtacactaactagtactattaattacacggagtattgttgttaaaatgcaaacacaatcagggtactcacataacataaacaaagttgatattgatgtgtatggcttgggctgttcaaagccagtaagattgaaatggccgtccaaaacatactggaatatgttctttaagttttctcatagtttttaaagggactatgaattttattccaacacattgtcttccacagcatggactctgaacacatcatactttatcaacatatgaaaaagtgtattaattttatacaatttacttataggccacctttataatcacttgaagacgttatgttgctcaaacataagtggctcctttggcaatttctatatttgtggaaatttggaaaggcatagtttcaacatgcaagaatgtaattatattgcttcatctaataatatctcacatatctgtctatcttcagattttagattttctttattaaaaaaaccatcatggtagctccatctcgtttgtaacttctccctctcaaatactcagaagaatgaagaggccaaattcagaaaatcatggcttcactgggaaatgttttaaatctacatgtagctaggatatgtgatttcatattttttaaaaatgtggtgtaaataagtgtaaaaaattaccacttgcaaagtggttttattacagcgttaaagaaaatgactagaattctgatagattgtgctgatgaacctggttgtgggcaattgaattcttgtcttcccactaccatttcatgactgtcgtctgaacactattcaacaccattaaatataaactctgatataaaagatgactacag

SEQ ID NO: 306205 - DNA, 1365 bp, Homo sapiens
ctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggtacaaaggcacagggaagaagatgcaggggagggtgaggataagtcatcactggctgactcacccaaagcaaagcttttgctacaggcttttgttgtgggctccactgctcatgtcattgctagagttcacttgtagggtcctctgcgtgactgggctgctcaagctgactttacaagacaaagtgaaaagaagcatggagataattatatggatatttcagggccttatttttgaggaagaggctacacagctcctggccttcattggttaaaagtgcagtataacagctttattgcatttcattttacttgcataaaccctcaccaaaaaaaaagtatatgggtttattttttcccattcaaaggcaaacatttatttagtcaaccaatatttcttgagtgcccactacttgctcatcactgtgcttggccctggggaaacagtcaaacacaagtatataaagccttggacacttaccaagtagtagccagtgcactgagggtcttgagagggaag

SEQ ID NO: 306206 - DNA, 1406 bp, Homo sapiens
taggtatgaatatgcatgttgtatatgtttgggggcattatacacagatttttaagtgattcctggtatccagaaaggattaagattaggaaagtctctgagcttttgtagtgtcaataaacatttatctccactggtttgtttttctgtttccctaaccgttcggcttaaaactggccctccaaaaatgaatctgttagcaagtttatactgatccatcctcgttttcagatataccatcctcaggttctacagagccagaattgtctcaaagcgtacttgatgcttttgaccttgcgcttcccaagataaaaattctgacggagggatttgtggacttgattttcacaaggcctgcgaggtgtttacaagcctcgagggctttgagtagaaaaggtagggtcatgcgctagctagggagatatcggagagaggaagtgctgcacaggacccagatgatagcggtttcaaatactggcttagtctgcggcgggcgcaggtcccctcacccggcaccctgtggttcagcacaggagggttctttctctccgcgggcactgattccgggtcgcggcggacgtcgcttccggagcagcatggcggccactgaggatgagaggctagcagggagcggtgagggagagcggctggatttcttacgggatcggcacgtgcgatttttccagcgctgcctccaggttttgccggagcgctattcttcactcgagacaagcaggtaactcgtggcacagtcagccaggctggcacaaggcccgggctccagcggaaaggcgcggcggagtcggaccgcaaactgggcgccggaagggggctgcgcggccgcccagttggcactgactggtttcaagtgggcttgaggttacccccactctcccgccgtacggtgggaaggtctggaaggctgtaggtcgagggctgtggcatctccagtttccggctttttcacttcccttttcttctggcaactctgagctgcttttttacccgctcccatagcctgtcactttgcctcattacttccgagtgtaaaaggaaaaggacaaagtttgtcgtcgtatttttagatgaatacttctgtgcatccttgtcctctctaaagtcattaactcttaatagagtgtctgtatggtgttttatgtgtaggagcggcagagaacctctaaggtcttagaaactttgtgggaactataaatctaatggtaggcgaaagaggtgtggtgttgcgtgaagcagcctgttaaaagtatcgcaatagctgaagagtgtggtgcggcagagactaagcgacttcatttacagtaaaagctggggatgagaagaaagaaaggagaaggcaatctttgctccgcattgctgtgttttgaagtgaagctcaaaagctgctt

SEQ ID NO: 306207 - DNA, 3027 bp, Homo sapiens
gaataaaatgaacaattcagttcctcagtcacatgagctgtgtgtcaaatgcacaacagccgtatgtggctcgtggcccctgtaccggacactcccatccctgcagagttactggacagtgctgatctagggattctgttacaaaatccatgaaagtgttcagcacaatgccgggcccatataaacgtcagtagttgttgttattataattagtcttgacccaacggcaaattcactttgagaccttagataaatcactctacctctctgagcctggtttccttgccctaaaaggatggcaaggggctgggcatggcggccactgaggatgagaggctagcagggagcggtgagggagagcggctggatttcttacgggatcggcacgtgcgatttttccagcgctgcctccaggttttgccggagcgctattcttcactcgagacaagcaggttgacaattgcattttttgcactctccgggctggatatgttggattccttagatgtggtgaacaaagatgatataatagagtggatttattccctgcaggtccttcccacagaagacagatcaaatctaaatcgctgtggtttccgaggctcttcatacctgggtattccgttcaatccatcaaaggctcctggaacagctcatccttatgatagtggccacattgcaatgacctacactggcctctcatgcttagttattcttggagacgacttaagccgagtaaataaagaagcttgcttagcgggcttgagagcccttcagctggaagatgggagtttttgtgcagtacctgaaggcagtgaaaatgacatgcgatttgtgtactgtgcttcctgtatttgctatatgctcaacaactggtcaggcatggatatgaaaaaagccatcacctatattagaaggagtatgtcctatgacaatggactggcacagggagctggacttgaatctcatggaggatcaactttttgtggcattgcctcactatgtctgatgggtaaactagaagaagttttttcagaaaaagaattgaacaggataaagaggtggtgtataatgaggcaacaaaatggttatcatggaagacctaataagcctgtagacacctgttattctttttgggtgggagcaactctgaagcttctaaaaattttccaatacactaactttgagaaaaatagaaattacatcttatcaactcaagatcgccttgtagggggatttgccaagtggccagacagtcatccagatgctttgcatgcatactttgggatctgtggcctgtcactaatggaggaaagtggaatttgtaaagttcatcctgctctgaatgtaagcacacggacttctgaacgccttctagatctccatcaaagctggaaaaccaaggactctaaacaatgctcagagaatgtacatatctccacatgactgattttagattgggagggtggggggatttgtagcataactgtagctcaagtttaaaagccatgtataaccaagtgtgctctttttttaaaaggtagagtcttacaatcaaatctcctgctgatttcactttgggatatggtcttgagccagtaatctttatactgggtttcaagaaaatctttgttgaagtttgaaccacaactttgtcgtggttcttaaatgtttatactgtatttctaagaagttgtttgaggcaaattaactgtatgtgtgtaggttatctttttaaaaactcttcagtgcaaattgtatcttattataaaatggacacaaattttcaagtttacacttcatatagcattgataatcttcaggtgaacacttagtgatcatttaaaaagctcactgctgatcgtagaaaatttgctttaattaattaagtatctgggattattctttgaaaacagatgaccataattttttttaaagaagagtgacttattttgtcttattcttaagtaaagtgtgccaattaaacctgtgtggcctatataaatgaagttaataacttcatagtaagaataaataggtttaactaatgtgatagttttctaaaaggagattgtttgaagacaactattatgtaactgagggaaaagcaacttaactgtatgtgattgtgaatgagaaagtttgtgctatgtgggtcatttatctagacattgctgtggtgaataccagttatgtttgattttattctcaaatcattagttgcctttttttttttttattttgtgctttctaggaagaaaacaatcttttttatctagaagggaaagatactttgtgttttcatttttagccatttgaagtttttaatttattgcccccagtgtgttagctgctctaatttcaaacctaatacttttctaatttttttcaaattaaataagtaaaaaatacaaaaacagaaccattcaaacagattcagtggtgtaactcaatacatggtcatttttattctcatattttcaggtaagtgaaagggaaatgcgaccatttagagggtaagaaatagggttttgtttttgttcattgttttgttttaagtctatgaactagctaattataaaggaggtagtataaaaactcttcattagtaattaatttatcaataactcatatccattacttgctcagtgacattcagaactattgcgtctagtactgaaatggggaaagaaatctcttcactaaaggagttggctttaagttagtcttggtgataataaatgttgaaatacaagtatcagtataaaaactggattactggtatcactgtttaggcattgtaatactttaaatgttatctttttttctaaatcagagggaaaaaaatgttgtgaaataacagtccttcccaagggaaacactgtgtacttggagaaatgattgatttattattggcatgcttagttttaaacctgagtttgccaactgtatgttttttaattagaaataaaataaatcttctgatggtgggggaaaaagtaagcttaataacagatgttatccgtc

SEQ ID NO: 306208 - DNA, 2985 bp, Homo sapiens
gaataaaatgaacaattcagttcctcagtcacatgagctgtgtgtcaaatgcacaacagccgtatgtggctcgtggcccctgtaccggacactcccatccctgcagagttactggacagtgctgatctagggattctgttacaaaatccatgaaagtgttcagcacaatgccgggcccatataaacgtcagtagttgttgttattataattagtcttgacccaacggcaaattcactttgagaccttagataaatcactctacctctctgagcctggtttccttgccctaaaaggatggcaaggggctgggcatggcggccactgaggatgagaggctagcagggagcggtgagggagagcggctggatttcttacgggatcggcacgtgcgatttttccagcgctgcctccaggttttgccggagcgctattcttcactcgagacaagcaggttgacaattgcattttttgcactctccgggctggatatgttggattccttagatgtggtgaacaaagatgatataatagagtggatttattccctgcaggtccttcccacagaagacagatcaaatctaaatcgctgtggtttccgaggctcttcatacctgggtattccgttcaatccatcaaaggctcctggaacagctcatccttatgatagtggccacattgcaatgacctacactggcctctcatgcttagttattcttggagacgacttaagccgagtaaataaagaagcttgcttagcgggcttgagagcccttcagctggaagatgggagtttttgtgcagtacctgaaggcagtgaaaatgacatgcgatttgtgtactgtgcttcctgtatttgctatatgctcaacaactggtcaggcatggatatgaaaaaagccatcacctatattagaaggagtatgtcctatgacaatggactggcacagggagctggacttgaatctcatggaggatcaactttttgtggcattgcctcactatgtctgatgggtaaactagaagaagttttttcagaaaaagaattgaacaggataaagaggtggtgtataatgaggcaacaaaatggttatcatggaagacctaataagcctgtagacacctgttattctttttgggtgggagcaactctgaagcttctaaaaattttccaatacactaactttgagaaaaatagaaattacatcttatcaactcaagatcgccttgtagggggatttgccaagtggccagacagtcatccagatgctttgcatgcatactttgggatctgtggcctgtcactaatggaggaaagtggaatttgtaaagttcatcctgctctgaatgtaagcacacggacttctgaacgccttctagatctccatcaaagctggaaaaccaaggactctaaacaatgctcagagaatgtacatatctccacatgactgattttagattgggagggtggggggatttgtagcataactgtagctcaagtttaaaagccatgtataaccaagtgtgctctttttttaaaaggtagagtcttacaatcaaatctcctgctgatttcactttgggatatggtcttgagccagtaatctttatactgggtttcaagaaaatctttgttgaagtttgaaccacaactttgtcgtggttcttaaatgtttatactgtatttctaagaagttgtttgaggcaaattaactgtatgtgtgtaggttatctttttaaaaactcttcagtgcaaattgtatcttattataaaatggacacaaattttcaagtttacacttcatatagcattgataatcttcaggtgaacacttagtgatcatttaaaaagctcactgctgatcgtagaaaatttgctttaattaattaagtatctgggattattctttgaaaacagatgaccataattttttttaaagaagagtgacttattttgtcttattcttaagtaaagtgtgccaattaaacctgtgtggcctatataaatgaagttaataacttcatagtaagaataaataggtttaactaatgtgatagttttctaaaaggagattgtttgaagacaactattatgtaactgagggaaaagcaacttaactgtatgtgattgtgaatgagaaagtttgtgctatgtgggtcatttatctagacattgctgtggtgaataccagttatgtttgattttattctcaaatcattagttgcctttttttttttttattttgtgctttctaggaagaaaacaatcttttttatctagaagggaaagatactttgtgttttcatttttagccatttgaagtttttaatttattgcccccagtgtgttagctgctctaatttcaaacctaatacttttctaatttttttcaaattaaataagtaaaaaatacaaaaacagaaccattcaaacagattcagtggtgtaactcaatacatggtcatttttattctcatattttcaggtaagtgaaagggaaatgcgaccatttagagggtaagaaatagggttttgtttttgttcattgttttgttttaagtctatgaactagctaattataaaggaggtagtataaaaactcttcattagtaattaatttatcaataactcatatccattacttgctcagtgacattcagaactattgcgtctagtactgaaatggggaaagaaatctcttcactaaaggagttggctttaagttagtcttggtgataataaatgttgaaatacaagtatcagtataaaaactggattactggtatcactgtttaggcattgtaatactttaaatgttatctttttttctaaatcagagggaaaaaaatgttgtgaaataacagtccttcccaagggaaacactgtgtacttggagaaatgattgatttattattggcatgcttagttttaaacctgagtttgccaactgtatgttttttaattagaaataaaataaatcttctga

SEQ ID NO: 306209 - DNA, 3311 bp, Homo sapiens
taggtatgaatatgcatgttgtatatgtttgggggcattatacacagatttttaagtgattcctggtatccagaaaggattaagattaggaaagtctctgagcttttgtagtgtcaataaacatttatctccactggtttgtttttctgtttccctaaccgttcggcttaaaactggccctccaaaaatgaatctgttagcaagtttatactgatccatcctcgttttcagatataccatcctcaggttctacagagccagaattgtctcaaagcgtacttgatgcttttgaccttgcgcttcccaagataaaaattctgacggagggatttgtggacttgattttcacaaggcctgcgaggtgtttacaagcctcgagggctttgagtagaaaaggtagggtcatgcgctagctagggagatatcggagagaggaagtgctgcacaggacccagatgatagcggtttcaaatactggcttagtctgcggcgggcgcaggtcccctcacccggcaccctgtggttcagcacaggagggttctttctctccgcgggcactgattccgggtcgcggcggacgtcgcttccggagcagcatggcggccactgaggatgagaggctagcagggagcggtgagggagagcggctggatttcttacgggatcggcacgtgcgatttttccagcgctgcctccaggttttgccggagcgctattcttcactcgagacaagcaggttgacaattgcattttttgcactctccgggctggatatgttggattccttagatgtggtgaacaaagatgatataatagagtggatttattccctgcaggtccttcccacagaagacagatcaaatctaaatcgctgtggtttccgaggctcttcatacctgggtattccgttcaatccatcaaaggctcctggaacagctcatccttatgatagtggccacattgcaatgacctacactggcctctcatgcttagttattcttggagacgacttaagccgagtaaataaagaagcttgcttagcgggcttgagagcccttcagctggaagatgggagtttttgtgcagtacctgaaggcagtgaaaatgacatgcgatttgtgtactgtgcttcctgtatttgctatatgctcaacaactggtcaggcatggatatgaaaaaagccatcacctatattagaaggagtatgtcctatgacaatggactggcacagggagctggacttgaatctcatggaggatcaactttttgtggcattgcctcactatgtctgatgggtaaactagaagaagttttttcagaaaaagaattgaacaggataaagaggtggtgtataatgaggcaacaaaatggttatcatggaagacctaataagcctgtagacacctgttattctttttgggtgggagcaactctgaagcttctaaaaattttccaatacactaactttgagaaaaatagaaattacatcttatcaactcaagatcgccttgtagggggatttgccaagtggccagacagtcatccagatgctttgcatgcatactttgggatctgtggcctgtcactaatggaggaaagtggaatttgtaaagttcatcctgctctgaatgtaagcacacggacttctgaacgccttctagatctccatcaaagctggaaaaccaaggactctaaacaatgctcagagaatgtacatatctccacatgactgattttagattgggagggtggggggatttgtagcataactgtagctcaagtttaaaagccatgtataaccaagtgtgctctttttttaaaaggtagagtcttacaatcaaatctcctgctgatttcactttgggatatggtcttgagccagtaatctttatactgggtttcaagaaaatctttgttgaagtttgaaccacaactttgtcgtggttcttaaatgtttatactgtatttctaagaagttgtttgaggcaaattaactgtatgtgtgtaggttatctttttaaaaactcttcagtgcaaattgtatcttattataaaatggacacaaattttcaagtttacacttcatatagcattgataatcttcaggtgaacacttagtgatcatttaaaaagctcactgctgatcgtagaaaatttgctttaattaattaagtatctgggattattctttgaaaacagatgaccataattttttttaaagaagagtgacttattttgtcttattcttaagtaaagtgtgccaattaaacctgtgtggcctatataaatgaagttaataacttcatagtaagaataaataggtttaactaatgtgatagttttctaaaaggagattgtttgaagacaactattatgtaactgagggaaaagcaacttaactgtatgtgattgtgaatgagaaagtttgtgctatgtgggtcatttatctagacattgctgtggtgaataccagttatgtttgattttattctcaaatcattagttgcctttttttttttttattttgtgctttctaggaagaaaacaatcttttttatctagaagggaaagatactttgtgttttcatttttagccatttgaagtttttaatttattgcccccagtgtgttagctgctctaatttcaaacctaatacttttctaatttttttcaaattaaataagtaaaaaatacaaaaacagaaccattcaaacagattcagtggtgtaactcaatacatggtcatttttattctcatattttcaggtaagtgaaagggaaatgcgaccatttagagggtaagaaatagggttttgtttttgttcattgttttgttttaagtctatgaactagctaattataaaggaggtagtataaaaactcttcattagtaattaatttatcaataactcatatccattacttgctcagtgacattcagaactattgcgtctagtactgaaatggggaaagaaatctcttcactaaaggagttggctttaagttagtcttggtgataataaatgttgaaatacaagtatcagtataaaaactggattactggtatcactgtttaggcattgtaatactttaaatgttatctttttttctaaatcagagggaaaaaaatgttgtgaaataacagtccttcccaagggaaacactgtgtacttggagaaatgattgatttattattggcatgcttagttttaaacctgagtttgccaactgtatgttttttaattagaaataaaataaatcttctgatggtgggggaaaaagtaagcttaataacagatgttatccgtc

SEQ ID NO: 306210 - DNA, 3199 bp, Homo sapiens
taggtatgaatatgcatgttgtatatgtttgggggcattatacacagatttttaagtgattcctggtatccagaaaggattaagattaggaaagtctctgagcttttgtagtgtcaataaacatttatctccactggtttgtttttctgtttccctaaccgttcggcttaaaactggccctccaaaaatgaatctgttagcaagtttatactgatccatcctcgttttcagatataccatcctcaggttctacagagccagaattgtctcaaagcgtacttgatgcttttgaccttgcgcttcccaagataaaaattctgacggagggatttgtggacttgattttcacaaggcctgcgaggtgtttacaagcctcgagggctttgagtagaaaaggtagggtcatgcgctagctagggagatatcggagagaggaagtgctgcacaggacccagatgatagcggtttcaaatactggcttagtctgcggcgggcgcaggtcccctcacccggcaccctgtggttcagcacaggagggttctttctctccgcgggcactgattccgggtcgcggcggacgtcgcttccggagcagcatggcggccactgaggatgagaggctagcagggagcggtgagggagagcggctggatttcttacgggatcggcacgtgcgatttttccagcgctgcctccaggttttgccggagcgctattcttcactcgagacaagcaggttgacaattgcattttttgcactctccgggctggatatgttggattccttagatgtggtgaacaaagatgatataatagagtggatttattccctgcaggtccttcccacagaagacagatcaaatctaaatcgctgtggtttccgaggctcttcatacctgggtattccgttcaatccatcaaaggctcctggaacagctcatccttatgatagtggccacattgcaatgacctacactggcctctcatgcttagttattcttggagacgacttaagccgagtaaataaagaagcttgcttagcgggcttgagagcccttcagctggaagatgggagtttttgtgcagtacctgaaggcagtgaaaatgacatgcgatttgtgtactgtgcttcctgtatttgctatatgctcaacaactggtcaggcatggatatgaaaaaagccatcacctatattagaaggagtatgtcctatgacaatggactggcacagggagctggacttgaatctcatggaggatcaactttttgtggcattgcctcactatgtctgatgggtaaactagaagaagttttttcagaaaaagaattgaacaggataaagaggtggtgtataatgaggcaacaaaatggttatcatggaagacctaataagcctgtagacacctgttattctttttgggtgggagcaactctgaagcttctaaaaattttccaatacactaactttgagaaaaatagaaattacatcttatcaactcaagatcgccttgtagggggatttgccaagtggccagacagtcatccagatgctttgcatgcatactttgggatctgtggcctgtcactaatggaggaaagtggaatttgtaaagttcatcctgctctgaatgtaagcacacggacttctgaacgccttctagatctccatcaaagctggaaaaccaaggactctaaacaatgctcagagaatgtagagtcttacaatcaaatctcctgctgatttcactttgggatatggtcttgagccagtaatctttatactgggtttcaagaaaatctttgttgaagtttgaaccacaactttgtcgtggttcttaaatgtttatactgtatttctaagaagttgtttgaggcaaattaactgtatgtgtgtaggttatctttttaaaaactcttcagtgcaaattgtatcttattataaaatggacacaaattttcaagtttacacttcatatagcattgataatcttcaggtgaacacttagtgatcatttaaaaagctcactgctgatcgtagaaaatttgctttaattaattaagtatctgggattattctttgaaaacagatgaccataattttttttaaagaagagtgacttattttgtcttattcttaagtaaagtgtgccaattaaacctgtgtggcctatataaatgaagttaataacttcatagtaagaataaataggtttaactaatgtgatagttttctaaaaggagattgtttgaagacaactattatgtaactgagggaaaagcaacttaactgtatgtgattgtgaatgagaaagtttgtgctatgtgggtcatttatctagacattgctgtggtgaataccagttatgtttgattttattctcaaatcattagttgcctttttttttttttattttgtgctttctaggaagaaaacaatcttttttatctagaagggaaagatactttgtgttttcatttttagccatttgaagtttttaatttattgcccccagtgtgttagctgctctaatttcaaacctaatacttttctaatttttttcaaattaaataagtaaaaaatacaaaaacagaaccattcaaacagattcagtggtgtaactcaatacatggtcatttttattctcatattttcaggtaagtgaaagggaaatgcgaccatttagagggtaagaaatagggttttgtttttgttcattgttttgttttaagtctatgaactagctaattataaaggaggtagtataaaaactcttcattagtaattaatttatcaataactcatatccattacttgctcagtgacattcagaactattgcgtctagtactgaaatggggaaagaaatctcttcactaaaggagttggctttaagttagtcttggtgataataaatgttgaaatacaagtatcagtataaaaactggattactggtatcactgtttaggcattgtaatactttaaatgttatctttttttctaaatcagagggaaaaaaatgttgtgaaataacagtccttcccaagggaaacactgtgtacttggagaaatgattgatttattattggcatgcttagttttaaacctgagtttgccaactgtatgttttttaattagaaataaaataaatcttctgatggtgggggaaaaagtaagcttaataacagatgttatccgtc

SEQ ID NO: 306211 - DNA, 243 bp, Homo sapiens
agtataagccatatttaattttactatttactaaaaccttatgtcagatttcttaatgaaataagttttcatttcacttcattaattagtactatattaattttgtatttaggctcctggaacagctcatccttatgatagtggccacattgcaatgacctacactggcctctcatgcttagttattcttggagacgacttaagccgagtaaataaagaagcttgcttagcgggcttgagagc

SEQ ID NO: 306212 - DNA, 2404 bp, Homo sapiens
gggcgggcctcagacacactatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaata

SEQ ID NO: 306213 - DNA, 618 bp, Homo sapiens
ttgttttgttttgcttaaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaata

SEQ ID NO: 306214 - DNA, 4026 bp, Homo sapiens
gggcgggcctcagacacactatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaataaaaaaaaaaaaaaaaattttttaagtaagagcaatgtttactgagcgatacaggactgagtactatgaagggtttacaaggatggaaatgcaccccgcccccgccctggccacccccgacacccagaagactacagtacttaggagttacacacaacggccgtaactggtggctatctgttcataacaaacaaaccatagcatatttatactgtatcacatcgagtgattatagaaatccatatatatattgcttgtataaaatctttttttttgtaaaaaatattaaaaaaaaaaaaaaaaaaaaaggaaagtataaaaaacatgtgcagttgaaagccctgccaggacagccagtctgtaaacattcggtgagtatgtgctttggaaggcgcccgcgcctcagtgcccacagcaaactccagcagggctggcgagggtgcgcccggctgccgcctcctgggcagggccgcgctggaccgaggtgggtgggggcatcagggccccgcagcacgcccctctccagttcgcatcagggcgaggggcagggctgggggcaggtgggttgcagtttcattctgagttccatcctcagccgcgttttggttgcaactcatggcttttcctggctgttcggaggttccttggatgggtgccctggtgaagaggccagagaagagcccagggctgcctcgttgggcgtctccctggcctcggtgcctctgtcctgcctccttcaagtggggccccaggcaggacaaccctacccgagggtcaactttggtctcagcgcttggtccctctgggtttcctcagcccgctcttcctcctgggtggctgatctgagttcacaaaaaagctcggctgatgctggctgtgctgaacctcattgtacagtttttcatgcaccaaaggaagggccatctggggcccccctcctcctctctcttcgtcacttttccttctcctcttcctcctcctccacctcctcccagcccatggtcacttcttctcgagctgctcgagcagtgggttgccttctgactcgggggtcttgacactgtcggtccggacgatgcaggtggggcggtgtcggttcagcatcaggatggaggctgctgccgctcctgcttcagctcctcaatctgggtcttcagctctgcgttcatgagttccagccgctcggattcccgctgcagaaactccgtgcgctccttcttcttgttccggcatcgggctgctgcgactttgttcttctcccggcgccttttccttcgctcctcttcctcatctagctcacttttcacgggctggggcctcttgcccagtttcacctccaggaagtgcaagggtgcaatcatggccccgaggttgcggatgtcagcgtatttcagctcctccacagtcagggccgagctggggagcccggtcagggggccaagccctggcagggagcctgtggtcaccgaagggtccgggatctgcccaggcatcatagcaggaggagtggcaggccagccttaacctcccccgccgccttgggcgccctcctcaccgcgagagcgctcgcgctcctctccccgcggggcgtcccgcgctttagagcacactggggtaccggat

SEQ ID NO: 306215 - DNA, 4109 bp, Homo sapiens
tttgaattgttgaattataagaagcatgccttggactttgggctaatactcttaccctacatattgagtgaaatttcatcttatttccaacaccattacatcctcagcagctttttgtggttcataaatattctttgtaactttcatttcacatgtatcattctttgttcccaagtgtctttatttttcttcaaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaataaaaaaaaaaaaaaaaattttttaagtaagagcaatgtttactgagcgatacaggactgagtactatgaagggtttacaaggatggaaatgcaccccgcccccgccctggccacccccgacacccagaagactacagtacttaggagttacacacaacggccgtaactggtggctatctgttcataacaaacaaaccatagcatatttatactgtatcacatcgagtgattatagaaatccatatatatattgcttgtataaaatctttttttttgtaaaaaatattaaaaaaaaaaaaaaaaaaaaaggaaagtataaaaaacatgtgcagttgaaagccctgccaggacagccagtctgtaaacattcggtgagtatgtgctttggaaggcgcccgcgcctcagtgcccacagcaaactccagcagggctggcgagggtgcgcccggctgccgcctcctgggcagggccgcgctggaccgaggtgggtgggggcatcagggccccgcagcacgcccctctccagttcgcatcagggcgaggggcagggctgggggcaggtgggttgcagtttcattctgagttccatcctcagccgcgttttggttgcaactcatggcttttcctggctgttcggaggttccttggatgggtgccctggtgaagaggccagagaagagcccagggctgcctcgttgggcgtctccctggcctcggtgcctctgtcctgcctccttcaagtggggccccaggcaggacaaccctacccgagggtcaactttggtctcagcgcttggtccctctgggtttcctcagcccgctcttcctcctgggtggctgatctgagttcacaaaaaagctcggctgatgctggctgtgctgaacctcattgtacagtttttcatgcaccaaaggaagggccatctggggcccccctcctcctctctcttcgtcacttttccttctcctcttcctcctcctccacctcctcccagcccatggtcacttcttctcgagctgctcgagcagtgggttgccttctgactcgggggtcttgacactgtcggtccggacgatgcaggtggggcggtgtcggttcagcatcaggatggaggctgctgccgctcctgcttcagctcctcaatctgggtcttcagctctgcgttcatgagttccagccgctcggattcccgctgcagaaactccgtgcgctccttcttcttgttccggcatcgggctgctgcgactttgttcttctcccggcgccttttccttcgctcctcttcctcatctagctcacttttcacgggctggggcctcttgcccagtttcacctccaggaagtgcaagggtgcaatcatggccccgaggttgcggatgtcagcgtatttcagctcctccacagtcagggccgagctggggagcccggtcagggggccaagccctggcagggagcctgtggtcaccgaagggtccgggatctgcccaggcatcatagcaggaggagtggcaggccagccttaacctcccccgccgccttgggcgccctcctcaccgcgagagcgctcgcgctcctctccccgcggggcgtcccgcgctttagagcacactggggtaccggat

SEQ ID NO: 306216 - DNA, 3961 bp, Homo sapiens
cccgaggacagaagatacttgtgttttcctgtagttgacaaaaaacggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaataaaaaaaaaaaaaaaaattttttaagtaagagcaatgtttactgagcgatacaggactgagtactatgaagggtttacaaggatggaaatgcaccccgcccccgccctggccacccccgacacccagaagactacagtacttaggagttacacacaacggccgtaactggtggctatctgttcataacaaacaaaccatagcatatttatactgtatcacatcgagtgattatagaaatccatatatatattgcttgtataaaatctttttttttgtaaaaaatattaaaaaaaaaaaaaaaaaaaaaggaaagtataaaaaacatgtgcagttgaaagccctgccaggacagccagtctgtaaacattcggtgagtatgtgctttggaaggcgcccgcgcctcagtgcccacagcaaactccagcagggctggcgagggtgcgcccggctgccgcctcctgggcagggccgcgctggaccgaggtgggtgggggcatcagggccccgcagcacgcccctctccagttcgcatcagggcgaggggcagggctgggggcaggtgggttgcagtttcattctgagttccatcctcagccgcgttttggttgcaactcatggcttttcctggctgttcggaggttccttggatgggtgccctggtgaagaggccagagaagagcccagggctgcctcgttgggcgtctccctggcctcggtgcctctgtcctgcctccttcaagtggggccccaggcaggacaaccctacccgagggtcaactttggtctcagcgcttggtccctctgggtttcctcagcccgctcttcctcctgggtggctgatctgagttcacaaaaaagctcggctgatgctggctgtgctgaacctcattgtacagtttttcatgcaccaaaggaagggccatctggggcccccctcctcctctctcttcgtcacttttccttctcctcttcctcctcctccacctcctcccagcccatggtcacttcttctcgagctgctcgagcagtgggttgccttctgactcgggggtcttgacactgtcggtccggacgatgcaggtggggcggtgtcggttcagcatcaggatggaggctgctgccgctcctgcttcagctcctcaatctgggtcttcagctctgcgttcatgagttccagccgctcggattcccgctgcagaaactccgtgcgctccttcttcttgttccggcatcgggctgctgcgactttgttcttctcccggcgccttttccttcgctcctcttcctcatctagctcacttttcacgggctggggcctcttgcccagtttcacctccaggaagtgcaagggtgcaatcatggccccgaggttgcggatgtcagcgtatttcagctcctccacagtcagggccgagctggggagcccggtcagggggccaagccctggcagggagcctgtggtcaccgaagggtccgggatctgcccaggcatcatagcaggaggagtggcaggccagccttaacctcccccgccgccttgggcgccctcctcaccgcgagagcgctcgcgctcctctccccgcggggcgtcccgcgctttagagcacactggggtaccggat

SEQ ID NO: 306217 - DNA, 2487 bp, Homo sapiens
gggcgggcctcagacacactatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttcccc

SEQ ID NO: 306218 - DNA, 2955 bp, Homo sapiens
gggcgggcctcagacacactatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttccccagttagtagagtgtctgcggtttttgttctactatatgcttgtccatttttatttgtatctcatggtttgcagactgtttgaataatttatagtttcccatccctgttaaaaaccagctcttcaagctgaaatgctaattatattggcattacattgaattatgtacaaaattataaaatttggttatttaaaattaaaaagttaaatccagtggttttgttaaagattttgcttagtattcaatttttattactgttttttaaaaataatgaatcatcaaagtttaaccacaggctggtgcccgggataacagtactgtaattggaaatggctttactctgaaaattaggttagtgggttggtgtaaattatttatttttgcttatgtacttttgttttaaagcttatttaccccaaagtttattattaattttgaatacagcaatttttaaaatgttaaaaaaaaa

SEQ ID NO: 306219 - DNA, 2394 bp, Homo sapiens
gggcgggcctcagacacactatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttcccc

SEQ ID NO: 306220 - DNA, 3172 bp, Homo sapiens
gggcgggcctcagacacactatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaataaaaaaaaaaaaaaaaaaaaaaaaaaaaaaaaaaaaaaaaaaaaaaaaaaaaaaaaaaacaaaaaaaaaaaaaaaaacaggggggggggggcaaaagacccccgagggggacacgaataacgcgaaccacaagtttgttgcacagagggggccccaaaagagaggacgccataaaaacaaaaagagggaggaggcataacacacagaaggagagagagacacagcgaagagagaaaagaggggaaggacgccacacaagggcggggagagcacaacagcgggacacacacccacccgagaaaataataacccccagggaaagaaaaccacacgcggcaaagcgcgtgacaaccagccaaatatcagcaggagaagatcgcctcacggaaaataggaggaaaaaattttagccggagaagggagagctacgcactgcacgatgcggcgaaagaaacgacgacaagaagaagacaactagacgagcagcacggaggtgacaaaacggagaaggagggactggaagaagggaagagcgagactcataagcaggaaagaagcacaaggagaggggaccgagacaaaacaagtcgagcaccaacaagagaaaacaactacacaacaccaaacgaggaaaagaaaccagcccaggaaccaaagaccgaggaaaaccaaacaaataagacacatagactataacagaacacagaaccacgacgaaagagcggagaacagagagatgaagacaaaccaagagagagtctactagaaa

SEQ ID NO: 306221 - DNA, 2285 bp, Homo sapiens
ccgcctacctctgcctccccatgtgctaagattactggcatgagccactgtgcctggcttaagtaatttaagtaatactatttgttttatttagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttccccagttagtagagtgtctgcggtttttgttctactatatgcttgtccatttttatttgtatctcatggtttgcagactgtttgaataatttatagtttcccatccctgttaaaaaccagctcttcaagctgaaatgctaattatattggcattacattgaattatgtacaaaattataaaatttggttatttaaaattaaaaagttaaatccagtggttttgttaaagattttgcttagtattcaatttttattactgttttttaaaaataatgaatcatcaaagtttaaccacaggctggtgcccgggataacagtactgtaattggaaatggctttactctgaaaattaggttagtgggttggtgtaaattatttatttttgcttatgtacttttgttttaaagcttatttaccccaaagtttattattaattttgaatacagcaatttttaaaatgttaaaaaaaaa

SEQ ID NO: 306222 - DNA, 2016 bp, Homo sapiens
gcacctgcccaggctcttccacagccacggtgtctgtattccgcatttcaggctcctccccatctgtcaacaccaacgcacccccgctgccctcatcatctacacccacctcacccaccaatccttgtcagggaacagtcttcaaatccagtaaaaactggaggaagaggaatgcaaacactctcagaaaatccgcccttcggagcctgctgtgttaattagcaaagctgtttctgaagctttatcacatccgtactggcccgccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaagggcaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttccccagttagtagagtgtctgcggtttttgttctactatatgcttgtccatttttatttgtatctcatggtttgcagactgtttgaataatttatagtttcccatccctgttaaaaaccagctcttcaagctgaaatgctaattatattggcattacattgaattatgtacaaaattataaaatttggttatttaaaattaaaaagttaaatccagtggttttgttaaagattttgcttagtattcaatttttattactgttttttaaaaataatgaatcatcaaagtttaaccacaggctggtgcccgggataacagtactgtaattggaaatggctttactctgaaaattaggttagtgggttggtgtaaattatttatttttgcttatgtacttttgttttaaagcttatttaccccaaagtttattattaattttgaatacagcaatttttaaaatgttaaaaaaaaa

SEQ ID NO: 306223 - DNA, 231 bp, Homo sapiens
tgcaagcttctccctgaaccatgtacttaaccagcctaaaccattatcaaaatgtaaaacattttaaagctttattttattcctataggtgtccattgatggaagtgaaagtgtagcaggtactggaatgattggagaaaatgagcaagagaaaaaaatgcaggtatgtaaagctactttttaatataaaaatctagcttagcatttctgtgcccttctgtggatgaaagc

SEQ ID NO: 306224 - DNA, 262 bp, Homo sapiens
gaaggaagacaaggctgtactttgttagcactcatcgtctacaaattaagaattaaaagcacacagaatctaaataaatggattgtcagtagcctacttgagatttcttctaatatccaaagggcttatgtttctttcagtttcattgtcagcataagctttgtgttatgcaaccagaaaatatagctttgaaatctaaaggacataagaattgccttaggagatttgcttccaaaataagaatcttcttgtcataatcatt

SEQ ID NO: 306225 - DNA, 582 bp, Homo sapiens
ggcaagttaagggaatagtggaatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcaggctcttgggcaatgtgctggtgtgtgtgctggcccgcaactttggcaaggaattcaccccacaaatgcaggctgc

SEQ ID NO: 306226 - DNA, 629 bp, Homo sapiens
ggcaagttaagggaatagtggaatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcagattactggtggtctacccttggacccagaggttctttgagtcctttggggatctgtcctctcctgatgctgttatgggcaaccctaaggtgaaggctcatggcaagaaggtgctaggtgcctttagtgatggcctggctcacctggacaacctcaagggcactttttctcagctgagtgagctgcactgtgacaagctgcacgtggatcctgagaacttcagggtgtgtaagaaggttcctgaggctctacagatagggagcacttgtttattttacaaagagtacatgggaaaagagaaaagcaagggaaccgtacaaggcattaatgggtgacacttctacc

SEQ ID NO: 306227 - DNA, 359 bp, Homo sapiens
ggcaagttaagggaatagtggaatgaaggttcatttttcattctcacaaactaatgaaaccctgcttatcttaaaccaacctgctcactggagcagggaggacaggaccagcataaaaggcagggcagagtcgactgttgcttacactttcttctgacataacagtgttcactagcaacctcaaacagacaccatggtgcatctgactcctgaggagaagactgctgtcaatgccctgtggggcaaagtgaacgtggatgcagttggtggtgaggccctgggcagctcttgggcaatgtgctggtgtgtgtgctggcccgcaactttggcaaggaattcaccccacaaatgcaggctgc

SEQ ID NO: 306228 - DNA, 2647 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattga

SEQ ID NO: 306229 - DNA, 679 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgcacctgccacgcccttcgctctcgcctccgcctacgctccccctctcagccccacccacgccccctttctacccgtctcgcgctccactctctctcagcggtccctacctcttctcaccgcatctcaccgccctttccgccccg

SEQ ID NO: 306230 - DNA, 3917 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306231 - DNA, 3947 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaaggtctggaccataacttctgtcagggcagagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306232 - DNA, 3873 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306233 - DNA, 3427 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306234 - DNA, 4200 bp, Homo sapiens
actctacgggaacaggtagctgggaccaagatgtgcatcaccacgcccagctgtgttttggttttgttttttatcagagtctggctctgtcgcccaggctggagtgcagtggcacgatctcagctcactgcaacctctgcctctcaggctaaagtgattctcctgcctcagcttcccaagtatgctgggattacaagcatgagccaccgtgactggctgattttttgttttgttttgttttaggactttgatcaatatagattggcaggcagggggttagatggttagatggtgccgcaaacataggagtagcccgttttttacatcagaaattgggaaatccacaaatagaatatttttctcctgatttatgcacgtagcaaaagttttatgaagatgtaacatttataccaaatttagtaattatgtatgtaacaggccacatttaatgaaagcataaccaggataaaataatttccttacccagctctttttcttctacagacacagcaggatgccaatgcctcttccctcttagacatctatagcttctggctcaagtaagcctttcctgttccattttggctattttctcccccaagataggctgggctgtgtttcttggtttgggaagattccagtcccctagaaattggtccaatctacctcagccaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306235 - DNA, 3861 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctcaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306236 - DNA, 3362 bp, Homo sapiens
cgacgactgctttggcctgtggagaagcagcagcctgtggaaagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306237 - DNA, 3404 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagaactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306238 - DNA, 3482 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306239 - DNA, 4240 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtgaaaaaaaaaagagaaaaaaaacaagaacaaaaaaaacagcaaaagaaaaagaaaacgacagaaaaaaagaaaagaaaaaaaggcaagagaagagaaggaaagaagaaagacaaaacgacaaagacagaaaacgagcaacaacgacacagagaaagaagagaagacgcaagaaggaagaaaacagaaagaaaaacaaccacgagagagacagaagcaacaagagaaacaaaaaaagggaaacaaacaaaacacggaccacaagacacgcaaaaagaacgaagaggagacaaacacaaaacccaccacggaaagcagagaagacg

SEQ ID NO: 306240 - DNA, 4819 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtgaaaaaaaaaaagaaaaaaaaaaaaaaaaaaaaaaaaaaaaaaaaaaaaaaaaaaacaaaaaacaaaaaaaaaaagaaaaaaaaaagaagaaaaagaaaaacaaaaagaaaaaacaaaaaaaacaagaacaagagaggaggcagcgcagacagacacacaaaacaggacaaggagaagacgagacagcgaaaaaagccaagcgaagaacaggaaaagaagcagcacacaactacataacaccgactcaaccaaataatgaagagcgcggaccggacgaagcagcaacacaacaatagcagcaaagcaggagagacaaagcaaaacaacaagaaaacagaaaataaaaagaaaagactaaacacacaaaacacaagaaccaaaaaacacaaaagcaaagaaaacaaaaaagaagaaaagaaaagtagacacacaacaaagacaaccaaaaaacaagaaagagaaagaaaagaaaaaaaaaaaaaaaaaaagaacaaagaaaaaaagagacgaagacaaaagcaatccagcagagaaaaaaaaaaataaaaactaaaaaaagagaaagaaaacaaaagagacaaaaaaaaaagagaaaaaaaacaagaacaaaaaaaacagcaaaagaaaaagaaaacgacagaaaaaaagaaaagaaaaaaaggcaagagaagagaaggaaagaagaaagacaaaacgacaaagacagaaaacgagcaacaacgacacagagaaagaagagaagacgcaagaaggaagaaaacagaaagaaaaacaaccacgagagagacagaagcaacaagagaaacaaaaaaagggaaacaaacaaaacacggaccacaagacacgcaaaaagaacgaagaggagacaaacacaaaacccaccacggaaagcagagaagacg

SEQ ID NO: 306241 - DNA, 4847 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtgtaaaacctgggcctggtttaaacaacacaaaaaaaaaaagaaaaaaaaaaaaaaaaaaaaaaaaaaaaaaaaaaaaaaaaaaacaaaaaacaaaaaaaaaaagaaaaaaaaaagaagaaaaagaaaaacaaaaagaaaaaacaaaaaaaacaagaacaagagaggaggcagcgcagacagacacacaaaacaggacaaggagaagacgagacagcgaaaaaagccaagcgaagaacaggaaaagaagcagcacacaactacataacaccgactcaaccaaataatgaagagcgcggaccggacgaagcagcaacacaacaatagcagcaaagcaggagagacaaagcaaaacaacaagaaaacagaaaataaaaagaaaagactaaacacacaaaacacaagaaccaaaaaacacaaaagcaaagaaaacaaaaaagaagaaaagaaaagtagacacacaacaaagacaaccaaaaaacaagaaagagaaagaaaagaaaaaaaaaaaaaaaaaaagaacaaagaaaaaaagagacgaagacaaaagcaatccagcagagaaaaaaaaaaataaaaactaaaaaaagagaaagaaaacaaaagagacaaaaaaaaaagagaaaaaaaacaagaacaaaaaaaacagcaaaagaaaaagaaaacgacagaaaaaaagaaaagaaaaaaaggcaagagaagagaaggaaagaagaaagacaaaacgacaaagacagaaaacgagcaacaacgacacagagaaagaagagaagacgcaagaaggaagaaaacagaaagaaaaacaaccacgagagagacagaagcaacaagagaaacaaaaaaagggaaacaaacaaaacacggaccacaagacacgcaaaaagaacgaagaggagacaaacacaaaacccaccacggaaagcagagaagacg

SEQ ID NO: 306242 - DNA, 2467 bp, Homo sapiens
ctcagtggccacctccttctcaagcaaagtgggcccacgcagccagagaggacagccttcctgagtaatcctcagcccctgattttgcaaacctgaagcactatcaaaaacagcagagtcttccaagtttatgcagcacttctgacccagacacacctcttggggccccgagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306243 - DNA, 3826 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306244 - DNA, 3481 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggatagggcttgtgttttagggtatcgttcggagcccccttggtgccgagctcg

SEQ ID NO: 306245 - DNA, 2381 bp, Homo sapiens
attaacaagaaattctgcagcatatgtttcaagggaagcactagggggagctccattttagacaggagaaaagcatgagaagtcttacatatatcatgtagtgatgtcacataggcagttggattatagcatatgactatatgtcatttactccatatagtaaccagtaacctccacagtatggaagttagcaaagaggactaggttggaaatataactggggagttgtcagttcatgggtgctatttaaagctacaagactgcatgagctcaccaaaggaatgagttagacaatgtagaaaagaggtttaaggacagacttttggagtactccaatgtcaagagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306246 - DNA, 3570 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtgggggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacgccaaacacacccctgtccccagacagcatttatggcacactctcctctccggtttcttcccggacttagccccgggcttc

SEQ ID NO: 306247 - DNA, 4047 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgattcaagttctgaagaagagaagaaacccccaactaaggcagtagtctctaaagcaaccactaaaccacctccagcaaagaaagcagcagagagctcttcagacagctcagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggttcattaaagaagcggaagcagaatgaggctgccaaggaggcagagactcctcaggccaagaagataaagcttcagacccctaacacatttccaaaaaggaagaaaggagaaaaaagggcatcatccccattccgaagggtcagggaggaggaaattgaggtggattcacgagttgcggacaactcctttgatgccaagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtaaaaaaaaaaaagaaaaaaaaaaaaaaaaaaaaaaaaaaaaaaaaaaaaaaaaaaacaaaaaacaaaaaaaaaaagaaaaaaaaaagaagagaggggggggcgcccctcacactcttctgggggggggcacacatctgcgccgccccccagtattacgaaaaaggcgggcccccccagaagggaggcgataatacacaaccgggccggacggcggcgcgcggcaacaacaaccaacagaagacacagggcggaaaaaccgggccgcgcgggcgccctctgtgaggggaaacaggcacaaaaatcacggaggggggagcgggagaacagggggacacaaaaaaacaaaacgagaaaaaaaaaaacccagagaacaaaagacaaaaaaaaaaaaggaggaaaagaggcggagaccaaacgcacgaggtgacacccccgccgagacgcaacaagcaccgcggcaagagtacgacacacagacgcagacgagaaaaccatactcccacgcagggagcgcagcaagaagaaaccgcagaccgaaaccccccgaccgtgagcggaggagaggaggaggggcgaaagagagccgggacgcggagggggagagcggaggcgagagcgcagggacgcggaggagagggagcgaagaagcaagagacgagagagaagacagaagcggcgaggaggcggacgcggagcagaagcagagagggagaccaggcgggagcgcaacggacggagacagaagaagagagcgcagagagacgaagagagaagcgacagggcggagcacagcgcacacgaccgccacgcgagcgcagcgcagagggcgacgaccccgagccagcagagagggagaagaagaagcgacgcacgccgaccgcacgacacacaagcagcacaagacaggcgaacagccgcacgcacagaaccaacagacaaacgaccacagaggacgaacgcaggaggagacagcccaggaccaaggagcacacctgaaccagtacgacacagccccaagacacacgccccacaccacgaccaaccgacaccgacaccagaccacgccgacccccacgcccccacacgcacccagcaccagcacgcccacgccacctgaccaccagcagccggaccgcgcacgcaccaccccagcgcacaccacgcacgactacgcacacgcgaagcgcaagcagcgaacccacccaccacca

SEQ ID NO: 306248 - DNA, 1293 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccaggtccctacagttcagtccccccgccttctgctcccccaccaaagaagtctctgggaacccagcctcccaagaaggctgtggagaagcagcagcctgtggaaagcagtgaagacagcagtgatgagtctgactttctcttctacacgtcctttcctgaagtgtcgagtccagtcctttgttgctgttgctgtgctggtgctggttgctgttggcatctt

SEQ ID NO: 306249 - DNA, 1141 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaacaggtctgccaaggtcccagagcgaaagttacaggcaaatggaccagtggctaagaaagctaagaagaaggcctcatccagtgacagtgaggacagcagcgaggaggaggaggaagttcaagggcctccagcaaagaaggctgctgtacctgccaagcgagtcggtctgcctcctgggaaggctgcagccaaagcatcagagagtagcagcagtgaagagtccagtgatgatgatgatgaggaggaccaaaagaaacagcctgtccagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagccagtagcagcagtagcagcagcagcagcagtagcagtgatgactcagaggaggagaaggcagcagccacccccaagaagactgtacctaaaaagcaagttgtggccaaggccccagtgaaagcagctaccacccctacccggaagagttctagcagtgaggattcctccagtgacgaggaagaggagcaaaaaaaacccatgaaaaataaaccagcctgaaaataacagggccaaagttcagccccgcttttgtccccaaaattctgggacagctccaagg

SEQ ID NO: 306250 - DNA, 1060 bp, Homo sapiens
  misc_feature (11)..(11): n is a, c, g, or t
  misc_feature (65)..(65): n is a, c, g, or t
  misc_feature (90)..(90): n is a, c, g, or t
  misc_feature (99)..(99): n is a, c, g, or t
  misc_feature (101)..(101): n is a, c, g, or t
  misc_feature (105)..(105): n is a, c, g, or t
  misc_feature (108)..(108): n is a, c, g, or t
  misc_feature (119)..(119): n is a, c, g, or t
  misc_feature (121)..(121): n is a, c, g, or t
  misc_feature (125)..(125): n is a, c, g, or t
  misc_feature (128)..(128): n is a, c, g, or t
  misc_feature (153)..(153): n is a, c, g, or t
  misc_feature (157)..(158): n is a, c, g, or t
  misc_feature (170)..(170): n is a, c, g, or t
  misc_feature (173)..(173): n is a, c, g, or t
  misc_feature (202)..(202): n is a, c, g, or t
  misc_feature (220)..(220): n is a, c, g, or t
  misc_feature (226)..(226): n is a, c, g, or t
  misc_feature (243)..(243): n is a, c, g, or t
  misc_feature (257)..(257): n is a, c, g, or t
  misc_feature (278)..(278): n is a, c, g, or t
  misc_feature (284)..(284): n is a, c, g, or t
  misc_feature (297)..(297): n is a, c, g, or t
  misc_feature (304)..(304): n is a, c, g, or t
  misc_feature (309)..(309): n is a, c, g, or t
  misc_feature (311)..(311): n is a, c, g, or t
  misc_feature (314)..(314): n is a, c, g, or t
  misc_feature (325)..(325): n is a, c, g, or t
  misc_feature (330)..(330): n is a, c, g, or t
  misc_feature (336)..(336): n is a, c, g, or t
  misc_feature (340)..(340): n is a, c, g, or t
  misc_feature (342)..(342): n is a, c, g, or t
  misc_feature (348)..(348): n is a, c, g, or t
  misc_feature (356)..(356): n is a, c, g, or t
  misc_feature (362)..(362): n is a, c, g, or t
  misc_feature (378)..(378): n is a, c, g, or t
  misc_feature (412)..(412): n is a, c, g, or t
  misc_feature (418)..(418): n is a, c, g, or t
  misc_feature (422)..(422): n is a, c, g, or t
  misc_feature (427)..(427): n is a, c, g, or t
  misc_feature (439)..(439): n is a, c, g, or t
  misc_feature (455)..(455): n is a, c, g, or t
  misc_feature (464)..(464): n is a, c, g, or t
  misc_feature (467)..(467): n is a, c, g, or t
  misc_feature (473)..(473): n is a, c, g, or t
  misc_feature (476)..(476): n is a, c, g, or t
  misc_feature (496)..(496): n is a, c, g, or t
  misc_feature (501)..(501): n is a, c, g, or t
  misc_feature (511)..(512): n is a, c, g, or t
  misc_feature (540)..(540): n is a, c, g, or t
  misc_feature (595)..(595): n is a, c, g, or t
  misc_feature (609)..(609): n is a, c, g, or t
  misc_feature (614)..(614): n is a, c, g, or t
  misc_feature (617)..(617): n is a, c, g, or t
  misc_feature (626)..(626): n is a, c, g, or t
  misc_feature (635)..(635): n is a, c, g, or t
tttgaaaaggncaaaacctttttgctagctgtttgaaaaagaacattttttttgaaccaaccttngacccccttcccctagttatttgangtttgctanangttngangcaacctgccntncttnctncgttttttttaccacgtattacgangaanncaaaaattgacncanttacgttttgaaaaaaactaccactactncacccttgggtactttgnctgttnctgtgggtttggcacgntgggtgaataccangacacttgggttttgcacttnaacttncccttaccactgngtttgangaaantncancttgacttcanagganacacgntggngngggganaaaaaaanaaccanaacctgttctaaaaanccgcttcacactcccttcacgttagggagagggntacganttancactntagggttgaaanatttattagggttaantcttattgntantggtgnctnaatttgggggtttgtgaaantgaancgcttaacannatgcaattatttacacttgattaaaacntgtgacgtggggttttggggagaaacaaaacctaaattagggatttattttgttntctcccttatgttnggtancgnttgggaggnaatttacantgcgcgcgcgcgtccagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtg

SEQ ID NO: 306251 - DNA, 1195 bp, Homo sapiens
aaccaagatggcgatacgcgtgggaccggaaagagtttatagatttcccgtctaccctacctctgaggtgaaggtgggactgccctgtggagcccaccctttccgttatgcgcccgcgcggcgcaatgacgtaacacaggcccgcccactgcccctgttgaattcgtgggtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctacacagcaggatgccaatgcctcttccctcttagacatctatagcttctggctcaaaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccagctcgagcagcacctaaaatagccaatggtaaagcagcctgctgctgctgccgccgccgccgccaggctgctgccttgcaactgaatggagcagttcccttgggggccctgaatccagcagctctgactgctctgagtccagccctgaaccttgcctcccagtgtttccagctctccagcctctttaccccccagaccatgtaaatcagtggcacagtatactgcctccttgtgcctctggatcctgccacttcacatctactcttccatggccccatttctccattttgtggaccaagccatcctgagggcatggacattgtctctgaggaaattggggccacccttaagataccaagaaaagctcctgcccatggtccccactggaaatgggactctgctgagcaaagccaccagcttgaagagaacagaaatccacacctggcatttgaattacctgtttcttccatgtgtattccgtctcctgagattaccttctttgccccttccaaacaccttagtggattccctccattttctccccattgggaaaggccctaaggggctttaactggaaggaaactgacctctctcccttaccggtaccttaaaccttattctgggagggaaacccttgacct

SEQ ID NO: 306252 - DNA, 888 bp, Homo sapiens
ccgcggcaaacatggcggtggactcggcgatggagctgttatttttagatacttttaaacacccgagcgctgaggtaaggcttggcgacttgattctgacgctgcttcttgacttgggatctttacaaaaaaaccgttaggcgttctccacttttccttctgcagattgcttctttaatttctcgcttacacacagacaccctcccccgagctgtgtgagcatcgcgtctgagggagggctgcagcagccccttcatttccttgctttaacttgggccctccgtgtctttggtcgagttggcttttctgcttgcatggctttattttttatttttcctgtcaggtttgggccttgagaaggatcagggttctcaggtttacctcagatggcgtttgggaggggtcttggtttgacagtagtgtttgacagtagtgccggagtctgagcagtttacgttggcttcgtggtttccgaatcacgatgtttctaaatcctttctctttggcctcttttctgtcgggaattatgttccccagttgtgacacttacttggtttaggattacggtgctctccgatttggcctgaaactttaatacttgtctctcggagagatttcacacattaggaatgagatgcattcacggagaatacttgcgaagaggggagagttgagagaattatagttaaactcatcagcagacatctcctttgaggttggaggtggaatgttgtggagtaatatttctgtacaaaactacttgagcgccccttaatgtacaattggccctgcaatatgtagattaaacatagctggttaactaaagattcctgaaagcagaccaaaaatgaacttgaatgaagtctacggagaaattgttaaaaaaaa

SEQ ID NO: 306253 - DNA, 386 bp, Homo sapiens
  misc_feature (85)..(85): n is a, c, g, or t
  misc_feature (93)..(93): n is a, c, g, or t
aaaaattttaaatattgtgggccccatgtaattgtaggtgcctgtaaccccccaaaaaaaccccaaaaggggttttttttttttngggggaanccatggctgtaccaaaagaaacaaaatactcctctcctttgtattagaaatctgaactttgcatttcagctttggacctactgacactattttattatacaaattatttaaagcctaaaataaggaatatcctaatactattattttgggaatcagaaacatctaataaagctggactttatacatagaaataaagcttacaactttgagaaagtagccatattttccccaagatacgtcttaacacactgagtctatataagtggcgtaaaatacagagttatcttaatcag

SEQ ID NO: 306254 - DNA, 5636 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgta

SEQ ID NO: 306255 - DNA, 5467 bp, Homo sapiens
  misc_feature (1846)..(1846): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaagctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgta

SEQ ID NO: 306256 - DNA, 5582 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgta

SEQ ID NO: 306257 - DNA, 6463 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgtacgtttgtatatattttcccttttttgtatgactatttatttagaaaatttctaggtgaaaaactaaatgatgttttgtatttttcttgcctatagcacagatattctcaaactttctcagctcatgacactatttagtgcctcagtacttttttcacagcatacctggtccaaaagaaatatctaatacttgtgtttattaagcagttagatccaacagcttaataagaatgtacatcatcaccactagtaactgtggacactgcatgtctcaaaccttggaatcagtatcattttcttttcctctctgcttcttgcacagtactttttatcaaactgctgaaaacccagttttgtaaagatatgttgttatagaaaggaatataatgctatttaatgttgaaaatgtaaactacctcaaagtagtagtttatgtgatgtccaacaggtgttgctatgtttttctcaaaaattttaaaatattgtgtggcacccatgttaatttgctaaggtgccctgctacacagtttgggaaccatggctgtaccaaaagaaacaaaatactcctctcctttgtattagaaatctgaactttgcatttcagctttggacctactgacactattttattatacaaattatttaaagcctaaaataaggaatatcctaatactattattttgggaatcagaaacatctaataaagctggactttatacatagaaataaagcttacaactttgagaaagtagccatattttccccaagatacgtcttaacacactgagtctatataagtggcgtaaaatacagagttatcttaatcag

SEQ ID NO: 306258 - DNA, 5586 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgta

SEQ ID NO: 306259 - DNA, 4473 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagaaagtgaacgggatcctctagacccccgca

SEQ ID NO: 306260 - DNA, 4072 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaaggtattttcattttgcattaaaaattttttcctcaaattatttttgacacatatattttttcccttacaatttggaaactagggtttggaatgcccagataacatatatacatgtaaatatacacatatacctacatatgcacacatatgaatatatgaatacttgtagacttttaaaattagaaagctttatttcatcatttcatgtgcaagatatcttgaaggtcttgatttgggattttcaaatggtgaatcctaaagaagtactctgatttaagaaaatatattattagaaacctgaatttataaaatttttgcagtcattgtaaaattccagagaatttgtcattatacccaaggaattaaatgttttatgcaaaatttgtgtaagttgatgtgtattgagaaataaatactagttaaacaatgccttaag

SEQ ID NO: 306261 - DNA, 4056 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagttaaaaattttttcctcaaattatttttgacacatatattttttcccttacaatttggaaactagggtttggaatgcccagataacatatatacatgtaaatatacacatatacctacatatgcacacatatgaatatatgaatacttgtagacttttaaaattagaaagctttatttcatcatttcatgtgcaagatatcttgaaggtcttgatttgggattttcaaatggtgaatcctaaagaagtactctgatttaagaaaatatattattagaaacctgaatttataaaatttttgcagtcattgtaaaattccagagaatttgtcattatacccaaggaattaaatgttttatgcaaaatttgtgtaagttgatgtgtattgagaaataaatactagttaaacaatgccttaag

SEQ ID NO: 306262 - DNA, 310 bp, Homo sapiens
tagtctacatttttgtatgactgtaatgcagtggttctctactctggctgtacattagaattacctggtgtgcttttaaaaatttattgatgtccatactcaccccaaagcaattaatccagaatctgggattgattttttttaatcacattttggggacaatacattaaactcaaactttgtggtttattgaatcaaaacaaaaatctagcatttgattatattaaaatatttgaatctagagagacgtcttcatgaactgtgatgttcagtgtttgagcttacatatttatttctactctcttgacag

SEQ ID NO: 306263 - DNA, 495 bp, Homo sapiens
cctgacgttggccccgaggaacctgcatatacagacagtcagcccattatatatatgcagattttgcatccctcaaataccatattttagatctctctttgctttaaaaaaatcacatgtaagtggacccacacagttcaaagccatgttgttcgggggtcatctgtaatttgaaagttctttttctgtctcccataaaacactagctgatggggagaaagaagatcagtttaatggaagccctccaagaccacagccaaggggaccaagaactcctccaggaccccctccacctgatgatgatgaagatgatcctgtgcctctgccaggtataaataaaaccagtgctaaggttttcccccctagttaatagtacatttttgtttttgttttgagatggtctcactctgttgcccagggtggagtacagtggctcactgcagtcttgaccacctgggcttaagtgatcctctcacctcagcctcctaagtagct

SEQ ID NO: 306264 - DNA, 5524 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgta

SEQ ID NO: 306265 - DNA, 5571 bp, Homo sapiens
  misc_feature (1950)..(1950): n is a, c, g, or t
tccagcctgggcgacaagagcaagactccgtctcaaaaaaaaaaaaaaaaaaaagaaaagaagaaaaagtaaagaagggcaagaggaagagactagagttgttgggtgcatatgattgaatttggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgta

SEQ ID NO: 306266 - DNA, 5582 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgta

SEQ ID NO: 306267 - DNA, 5304 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaagcacttcagaagataaagaaaaacagtatactagccaaaccaccaggttgcttgctcttcttgatgctctggcttcacacaaagcttgtaaattagctattttgcatctaattaatggaactattaaaggtgatgaaagatatgcagagatattccaggatcttttagctttggtgcggtctcctggagacagtgttattcgccaacagtgtgttgaatatgtcacatccattttgcagtctctctgtgatcaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaagttctttaaggaaaaacagtagtgctctgcatagtttactgaaacgagtggtcagcacatttagtaaggacacaggagagcttgcatcttcatttttagaatttatgagacaaattcttaactctgacacaattggatgctgtggagatgataatggtctcatggaagtagagggagctcatacatcacggacgatgagtattaatgctgcagagttaaaacagcttctacaaagcaaagaagaaagtccagaaaatttgttccttgaactagagaagcttgttttggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggactgcctatgtgcttgctgatgtcatggatgatcagttgaaatctatgtggttcactccatttcaggctgaagagatagatacagatctggatttggtaaaggttgacttaattgaactctctgaaaaatgctgtagtgactttgatttgcactcagaattagagcgctcatttttgtcagaaccatcatctccaggaagaaccaagactactaaaggattcaaacttgggaagcacaagcatgagacctttataacgtcaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgta

SEQ ID NO: 306268 - DNA, 899 bp, Homo sapiens
tcaagtggaaaatctgaatacattgacgttataaaggtctcatgcttgtgcttcccaagtttgagacctttataacgtcaagtggaaaatctgaatacattgaacctgccaaaagagctcatgttgtgccaccaccaagaggaaggggcaggggaggatttggacagggtatacgacctcatgatatttttcgtcagagaaaacagaacacaagtagaccaccatctatgcatgtggatgactttgttgctgctgaaagtaaagaagtggttcctcaagatggaatacctccaccaaaacggccactcaaagtatcacagaagatttcttcccgtggtgggttttcaggcaatagaggaggacggggtgctttccacagtcagaataggtttttcacaccacctgcttcaaaaggaaactacagtcgtcgggaaggaacaagaggctccagttggagtgctcagaatactcctcgaggaaattacaatgaaagtcgtggaggccagagcaattttaacagaggccctcttccaccattacgaccccttagttctacaggttaccgcccaagtcctcgggaccgtgcttctagaggtcgtgggggacttggaccttcctgggctagtgcaaatagcggcagtggaggctcaagaggaaagtttgttagtggaggcagtggtagaggtcgtcatgtacgctcctttacacgataaaaatccttttgggaacatcttaactgtatatgaacatttcacgaggacaataaaaataagacattgaaggaccaatttagacttagcagttatctggagacatctgagagaatatttttatctgaagaaagcagaatttgtttgatacctaacaagatttcaataaaaatccaaactttgtatgta

SEQ ID NO: 306269 - DNA, 3892 bp, Homo sapiens
  misc_feature (2015)..(2015): n is a, c, g, or t
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaagacttcatctcttcctaaccacagtgaacctgatcacgacacagatgctggacttgagagaacaaacccagaatatgaaaatgaggtggaagcttctatggatatggatcttttggaatcctcaaatataagtgaaggggaaatagaaaggcttattaacctcctagaagaagtttttcatttaatggaaactgcccctcatacaatgatccaacaacctgttaagtctttcccaacgatggcacgaattactggacctccagagagggatgatccntaccctgttctctttagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttgggtgattccaaatctaagaagtcagtagcttataattacgcatgcatacttattttggtggtggttcagtcttccagtgatgttcaaatgctagaacaacatgcagcatctctcttgaagctttgtaaagcagatgaaaataatgctaaattgcaagaacttggcaagtggcttgaacctctgaaaaaccttagatttgaaattaactgcatcccaaacttaattgagtatgttaagcagaatatcgataacttgatgaccccagaaggagttggccttaccactgccttacgtgttctctgtaatgttgcatgcccaccacctcctgttgaaggtcaacagaaagatctgaaatggaatcttgccgttattcagcttttttctgctgaaggaatggacacgtttattcgagttctgcaaaaattgaacagtattctgactcagccttggaggctccatgtcaacatggggactacccttcacagagttactactatttcaatggctcgctgcacactcactcttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggtatcacttccatataacatgcatcttataaatgactgcagtaacactttttaaaaagccagtgattttgttaaaaaacaaaaaccctcatctcccttcctcccaaaaagacataaaataaccggatgagggggagataaaactgaaacaagttggtcattgaggaaatatgggggtaacattttaaataaatttttgttaaagtgagttttattttgctgttatgtatgtttgtacttacatttttctgttattttaaatcctttcccccacaccttaccatgtgttagaatttgccaataactagattgcttcaccaatggactctgctcaactaactgctaacctgagaacaataagattttttagactcattgaattcaagcaaatgtttaactgtataatagaaaattaaatgttttaagcatgcagtaaaaatgttcttttcataacatttcttcctgaacagtttttgtgactataaataaata

SEQ ID NO: 306270 - DNA, 981 bp, Homo sapiens
ccgcggcaaacatggcggtggactcggcgatggagctgttatttttagatacttttaaacacccgagcgctgagcaaagttctcatatagatgtggttcgttttccatgtgtggtttatatcaatgaagtccgagtcatacccccaggagtaagagcccatagcagtctgccagacaatagagcatatggagagacatctccccatacatttcaattagacttattcttcaacaatgtaagcaaaccaagtgcccctgttttcgataggttgggaagcctggaatatgatgagaatacttccatcatctttagacctaactcaaaggtgaatactgatggtctggtgctaagaggctggtataactgtctgacactggcaatatatggatcagtggatagagtgataagtcatgacagagactctccaccaccaccacctccaccgccaccacctccccagccacaaccaagtttgaaaaggaatccaaaacatgctgatggggagaaagaagatcagtttaatggaagccctccaagaccacagccaaggggaccaagaactcctccaggaccccctccacctgatgatgatgaagatgatcctgtgcctctgccagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggggatgatggttatgaacaaatttccagagattgagtaggcaggatgcaggaagagaaaggaaagaaaaggacaaaggaaaggaaagaga

SEQ ID NO: 306271 - DNA, 1827 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgtt

SEQ ID NO: 306272 - DNA, 1566 bp, Homo sapiens
  misc_feature (1506)..(1506): n is a, c, g, or t
gcctcagcttttgaagctggtgagagcctggcctgtgctgggccttggccacgggcagcgtcagctttgagtcaagtgctggtctggcctccctagctttgagcctctgtcaattcccttaatctgtttaggctttggcttcctcatccatagaatggagatatgaatgattcctacgccgtagtgctttgagagaattcagtgaaattcctgtgtgtaaaacccttccatggtgcctagcacacagcacacagccaatggcccaatggctcctatcagctgtgggatttgtcatcagaacaccaccagctctgctccaggctgccctgggtaccatcaaaacacaccctgtgcccagcagcacctgctcctctgcacacctggttccttcagcaggggcagtggccgtgggagcacagaaaacatggagtcccatctggtttaattgatgccattgccaaaggggaggactcacggcaccccctctcgggtgccagggtgcctggctcccaccaggaggaagacctgtcctccactgtcaggcacatttcagtcttcccagcagccagcacaactactttgtccttccagtcacggtcggcctctgggaagcccagtctgtgtcctcctccttcaggggtagccagcatgtctgtgtcacccaaggtcatggagcacagggcccctcccgggaaggtgccgtctcctccggcccctcgggtccctgctctgtcactgactgctgtgacccactctgtctccgcagaggccacaggccaggtctgccatgccttgtgctcccccgagggctgctggggcccggagcccagggactgcgtctcttgccggaatgtcagccgaggcagggaatgcgtggacaagtgcaaccttctggaggggtaggaggttatttctttaatccccttgcgttgatcaaaaataaggctccaggttgttgttatagctttacaggcattctgtttgattttctcttccttttattctttgcccttggcttttggaggttttgggttttctgtggggagacgggaagttgtttgattgcgttatttttggcaaatttaagcacaataggaaataagcaagtattattgcctaatataatccaataatttatagaatctcttttcctggaagtatcttaaatttttctaagctacaaaaagttcctaagacaaatgagacagtcatcaatggttcatctagccaacaccgtggccatttgggcttttctttgtagtgcccgattcctggtgtgtgaaaataaattaacacaaattatattgccaagttaatatctgttttatgtgcccccagcatgtgttgaacatcaaacagtaccagggactttaaatatacccacggacaaagaaataattcataatgatgtttgttgaatttagttgcaatcaataaaaagtgcagtttgtgaatgctctgaggttcttgatattgatgtaaggctttgaacgacaaatgaggacnaaacataaataggaaagtaaaactgaaggatagaggccaaggccatgttttagaagattt

SEQ ID NO: 306273 - DNA, 974 bp, Homo sapiens
  misc_feature (879)..(879): n is a, c, g, or t
  misc_feature (881)..(881): n is a, c, g, or t
  misc_feature (883)..(883): n is a, c, g, or t
  misc_feature (891)..(891): n is a, c, g, or t
taggctagtacgagctggtgttaatcggccgggctgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggncngntccccagngggaattaatccgcggctcgggttagagaggtttccgcccagatctcctagctttgttgggtgggtcccatgtgctggggttc

SEQ ID NO: 306274 - DNA, 500 bp, Homo sapiens
tgattaaaaataaatcaggagaaaaaagaggcaatcagaaaagggcatggtttgacttagtttgaatgtggtttcgttggaagcaaatgtgtcttcactttttcatgaaaaagtctgcaagtgctctgcgacatccctgggaaatgatcctaccctcactcttcagctcacagggaacctttgctctttttcagtgaccaaaatcatctgtgcccagcagtgctccgggcgctgccgtggcaagtcccccagtgactgctgccacaaccagtgtgctgcaggctgcacaggcccccgggagagcgactgcctggtaagatgcccctccagcagcctccctggagcaggctggggctgcacccgccccacccacaccaggacagaagacttcctgtgggggagctgtcaattagcatttgtcataacagacaggatattgccctctgcctggtgacaaagtatctttagtatcctgcctccaccactcactgagaccttgg

SEQ ID NO: 306275 - DNA, 486 bp, Homo sapiens
agaagctatttgaatctcatgtaggggctttcaagcatcaaaggatggttcatgttttattttaaggcacccacatcatgtcatgaggggaggcagctataatttagagaaccaagggggatttcattataacaaaattggcaaacacacaggcacctgctggcaatagacccctgctcctatagccaagaagtggaatagcatctctacgggccattctaatagcctcaaaatctctgcaccagggggatgaaagaatgcatttgccaagtcctacagactccaacttctaccgtgccctgatggatgaagaagacatggacgacgtggtggatgccgacgagtacctcatcccacagcagggcttcttcagcagccccctcactcacactactacaggctccacccacaagcccataatctctacccttactactacaggccctaccctcaatatcatatggcccaagtccagactaccaccac

SEQ ID NO: 306276 - DNA, 532 bp, Homo sapiens
aataagttgaaaagattgtcttcatttattgaatgtgcttaactcaggcccgggaaagggcgtcatcagtttctcatcatttcactgagatatgcatctattacttttacatttcaggccaaaagtgtgatccaagctgtcccaatgggagctgctggggtgcaggagaggagaactgccagaaacgtaagtcagtgaacagcctcagacccatgtgtgaccgcccctctcttccttcacttgcttaggtgattggatttgttttccctctgaagactccaaagagttactttattacagggtcagatgtgaaccagtaggtgaaggacagtcttgcaaatctcaccgcatgcagttaatccagggtgggctattttgggagcttcagcctatcacaaataagtgaacatcagcaggggctgggcgcggtggctcacccctataatcccagcactttgggaggcggaggcggtcggatcacgaggtcaggagatcgagccattctggttaacacagtgaaacctcgtctcta

SEQ ID NO: 306277 - DNA, 430 bp, Homo sapiens
gaattcccgctctctgggtaggtctcagtgcggggttccagggggtccctctaatgagcatctcatgtcactgtgttctgtcacatgccagcctggcctccctgtgtcccagatcgcattattaaaccctccagcgcattagagcaagcctcagtaaggcgcaggccacatcgtgaactaagcagcatccgtgagtggggcccacccaactccatctccccctccccgtctgaactctcctctggtgctcgtcctcactgtccggctagccaaagcctcagctgggtctaagagagaagcatggtctattgggctttggtgtcaggcagacgtggcttcacacccctgactctccacttcttcgcatcacccaggcagccgatccacctatctccttccataacacaggaataccaaaaccaagctcaca

SEQ ID NO: 306278 - DNA, 5858 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactcta

SEQ ID NO: 306279 - DNA, 6615 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306280 - DNA, 6192 bp, Homo sapiens
ttttcaaagtaattctttttaatttccattttcactggagagtgttgaaccccgtgaggcatgagagcacagtgttccagaacaatgcttactgctcattatcacaggggtcaaaggctaacgtgcagggattgttgcagatcgtggacatgctgcctcctgtgtccatgactgcaatcgtctacctattttacagttgttgagcactcgtgtgcattagggttcaactgggcgtcctagggctccctggacccattttagaccttgagttcttgagttcctcaaaagagaaatcacgcatttatgttttctcttcttagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306281 - DNA, 7201 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaaggtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagctaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306282 - DNA, 6429 bp, Homo sapiens
tggggttggtcctaggaaaagccctcgctgtattgggtctggctcctttacacggcattgttctagcaaggctttctgccattcagcaatacattataaaatataccctcaattgtactttataagggaagcccaatgtcctttataagggaaattaaacataatttcattccatagtcaccgctataatgtgtgaactccatcatctatacgttagtaaacagacgtatttttatcataatccataaattatgataggtgggacagtgcacctaagaaaaaaatggactttttagagaagggtctttctgactctgcagagggcgccagctgggttttcccacactagtggaacactaggctgcaaagacagtaacttgggctttctgacgggagtcaacaccgtgctgcgcttcctccgtgtgtggcactgagtgtacttacctcacttgcccagcgtgtcctctctcctccataggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaaggtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagctaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306283 - DNA, 5771 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306284 - DNA, 5263 bp, Homo sapiens
  misc_feature (362)..(362): n is a, c, g, or t
atttaacctgcacagaatttgggacagagaacctctagtgtttgttcaataaatatatgaatggatagagggacaggttgggtggtggatagatggatgaacccacacctttgaagtgtatttggctgtttgagaggttagaatatgttctcaatttccaggcaaaatgaaaatggagaaaatataatgacattaaggcattttattcatcctccccatctgccactgggttaaagatactaaataaacaaggaactatcttttgcctggaggaactttaaaaacacctgcagttttcaaaaggtgcagtgtgtgcctcccacagcatgacctaccatcattggaaagcagtttgtagtcantcaaaggtggtctggagaaacaaagttttcagggatacattgtttttataatttttcaccacatgatttttcttctctccaatgtagtggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306285 - DNA, 5312 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgccgattctgtgctgatgaccgatattatg

SEQ ID NO: 306286 - DNA, 4804 bp, Homo sapiens
taggctagtacgagctggtgttaatcggccgggctgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306287 - DNA, 5380 bp, Homo sapiens
gcctcagcttttgaagctggtgagagcctggcctgtgctgggccttggccacgggcagcgtcagctttgagtcaagtgctggtctggcctccctagctttgagcctctgtcaattcccttaatctgtttaggctttggcttcctcatccatagaatggagatatgaatgattcctacgccgtagtgctttgagagaattcagtgaaattcctgtgtgtaaaacccttccatggtgcctagcacacagcacacagccaatggcccaatggctcctatcagctgtgggatttgtcatcagaacaccaccagctctgctccaggctgccctgggtaccatcaaaacacaccctgtgcccagcagcacctgctcctctgcacacctggttccttcagcaggggcagtggccgtgggagcacagaaaacatggagtcccatctggtttaattgatgccattgccaaaggggaggactcacggcaccccctctcgggtgccagggtgcctggctcccaccaggaggaagacctgtcctccactgtcaggcacatttcagtcttcccagcagccagcacaactactttgtccttccagtcacggtcggcctctgggaagcccagtctgtgtcctcctccttcaggggtagccagcatgtctgtgtcacccaaggtcatggagcacagggcccctcccgggaaggtgccgtctcctccggcccctcgggtccctgctctgtcactgactgctgtgacccactctgtctccgcagaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306288 - DNA, 3652 bp, Homo sapiens
aagccctttgcattccccttgagcgagagaagccacactgcctttctgtgtctggttcaaagctcttccttcttggcatgttttctggactacatgcacatgggcagctatagattaatctgcaaggaacccacgcgcgtgggttccttgcgaataggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306289 - DNA, 3411 bp, Homo sapiens
agaagctatttgaatctcatgtaggggctttcaagcatcaaaggatggttcatgttttattttaaggcacccacatcatgtcatgaggggaggcagctataatttagagaaccaagggggatttcattataacaaaattggcaaacacacaggcacctgctggcaatagacccctgctcctatagccaagaagtggaatagcatctctacgggccattctaatagcctcaaaatctctgcaccagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306290 - DNA, 2902 bp, Homo sapiens
ggctccagctccacagccagccacagcccaggacaatcaaccgcctatccaggggccgtcggtccgcatgtccccccgcaagccgctaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306291 - DNA, 2529 bp, Homo sapiens
tcggctcggtaccggtgtctgcacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306292 - DNA, 3965 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacacctcgtccagctaatttttgtagtttttgtaaagacaggatctccttatgttgcccaggctagtcttgaacttc

SEQ ID NO: 306293 - DNA, 3869 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcaggtacaaattgcagtctgtgcttccattgggaagagtccctctaatgagcatctcatgtcactgtgttctgtcacatgccagcctggcctccctgtgtcccagatcgcattattaaaccctccagcgcattagagcaagcctcagtaaggcgcaggccacatcgtgaactaagcagcatccgtgagtggggcccacccaactccatctccccctccccgtctgaactctcctctggtgctcgtcctcactgtccggctagccaaagcctcagctgggtctaagagagaagcatggtctattgggctttggtgtcaggcagacgtggcttcacacccctgactctccacttcttcgcatcacccaggcagccgatccacctatctccttccataacacaggaataccaaaaccaagctcaca

SEQ ID NO: 306294 - DNA, 1953 bp, Homo sapiens
  misc_feature (13)..(13): n is a, c, g, or t
tatcgagccggtnccggggtcagagccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306295 - DNA, 3122 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccaga

SEQ ID NO: 306296 - DNA, 2986 bp, Homo sapiens
  misc_feature (2501)..(2502): n is a, c, g, or t
  misc_feature (2531)..(2531): n is a, c, g, or t
  misc_feature (2639)..(2639): n is a, c, g, or t
  misc_feature (2705)..(2705): n is a, c, g, or t
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatggaagctacatagtgtctcactttccaagatcattctacaagatgtcagtgcactgaaacatgcaggggcgtgttgagtgnnaaggatcttgacaagttgttttgaagatngcattttgctaagtccctgaggtcactggtcctcaaagcggcatggcgcatggcgtggctggttctgccacatgccagctgtgtgacctctgagactccacttcttcngtgctgaaaataaagaaggagttttactaaggaccaaacaagataatgaatgtgaaactgctccangaaccccaaagaattatgcacatagatgcgatcattaagatgcgaagccatcgagttaccacctggcatgcttaaactgtaaagagtgggtcaaagtaaactgaattggaaaatccaaagttatgcagaaaaacaataaaggagatagtaaaaagggttaacgagccagtccaggggaagcgaagaagacaaaaagagtccttttctgggccaagtttgataaattaggcctcccgaccctttgctctgttgctttatcaactctactcggcaataacaat

SEQ ID NO: 306297 - DNA, 3683 bp, Homo sapiens
  misc_feature (3682)..(3682): n is a, c, g, or t
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaaggtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagctaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtgagtggaaagtgaaggagaacagaacatttcctctcttgcaaattcagagatcaaaaatgtctcccaagttttccggcaacaaattgccgaggtttgtatttgagtcagttacttaaggtgttttggtccccacagccatgccagtagcaacttgcttgtgagcaggcctcagtgcagtgggaatgactctgccatgcaccgtgtccccggccgggcctgtgttgtgcaatgctgcacatcacaacaggagggtagggggacaaaagagcacaggtcctggcagctgccacagtctccaggggcttttgcgtttctctccagatttctaaggttaacatggggattagctgttttgcaatgaataaaaggtaacattgcctggaatgttgcttaaagacacttttttaaagctagttgattgttaagctgttgctacttaaattaaaactactttgggccagacgcagtggctcacgcctgtaattccagcactttgggattccaaggcaggcagatcacttgaggtcaggagcttgagaccaggctggccaacatggtgaaaccccacctctactaaaaatacacctgtagtcccagctactcaggaggctgaggcaggagaattgcttgaacccgggaggcagaggttgcagtgagccaagatctcgccactgcactccagcctgagcaccaagagcgaaactctgtcnc

SEQ ID NO: 306298 - DNA, 1724 bp, Homo sapiens
ctgtgggctattggtccaaatgctgatgaatccaatgtgggctggaatccgagttattatttgatgtgtcatcctctcttgctgatttcatgacagcaagacaggggcagcatactgagtttcaaaacaatggaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttct

SEQ ID NO: 306299 - DNA, 3082 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaaggtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagctaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtcctaataaatcttcactgtctgactttagtctcccactaaaactgcatttcctttctacaatttcaatttctccctttgcttcaaataaagtcctgacactattcatttga

SEQ ID NO: 306300 - DNA, 3387 bp, Homo sapiens
  misc_feature (3327)..(3327): n is a, c, g, or t
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaaggtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagctaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggaggggtaggaggttatttctttaatccccttgcgttgatcaaaaataaggctccaggttgttgttatagctttacaggcattctgtttgattttctcttccttttattctttgcccttggcttttggaggttttgggttttctgtggggagacgggaagttgtttgattgcgttatttttggcaaatttaagcacaataggaaataagcaagtattattgcctaatataatccaataatttatagaatctcttttcctggaagtatcttaaatttttctaagctacaaaaagttcctaagacaaatgagacagtcatcaatggttcatctagccaacaccgtggccatttgggcttttctttgtagtgcccgattcctggtgtgtgaaaataaattaacacaaattatattgccaagttaatatctgttttatgtgcccccagcatgtgttgaacatcaaacagtaccagggactttaaatatacccacggacaaagaaataattcataatgatgtttgttgaatttagttgcaatcaataaaaagtgcagtttgtgaatgctctgaggttcttgatattgatgtaaggctttgaacgacaaatgaggacnaaacataaataggaaagtaaaactgaaggatagaggccaaggccatgttttagaagattt

SEQ ID NO: 306301 - DNA, 1701 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatccgtactggcccgcgggccagtacggatgtggggggccatatttaacattcttaaagaaagattttcagcccacgaatttcacact

SEQ ID NO: 306302 - DNA, 1832 bp, Homo sapiens
  misc_feature (1276)..(1276): n is a, c, g, or t
  misc_feature (1647)..(1647): n is a, c, g, or t
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgtaagtgtcgcatacacactatctctgcctccagctcctatgggggacagctctacagcactggggcaggggagagaagccatgtttagtaagtcacattaatcagaaacaaaaagtagtaagcaaaatatctgaccactagaaaagcatgtatttaccacggacatagagatcgtttttttgtggcgggtggcagcccagctggttggcagtncaggccaccggaggcagatcccctgcagggacagcagagcacttgtgtcctgagaagagctgctgttcatggggctggcagcaccagggcctctcctagcctgccctgctgacactggccagactcctacatgcttctgagtctccagaggctacccggccctcctgaagcaccagggctgaatccacccccagctgagggcatgaacactgccacatggagtcacacacacagctgggcactgccatggagaggaagtctgtccatgtttccttgaatactggtggcctggtccctgtcccattccccagtgaggcagcctgtggggaagcctggcagggaaccaggcgcaggtcagcgtggcgccctgnctcaggccagcactgatgggggactctgagacgcaagctcacactcacccagctcccctgggctgcgcccgttcctgatcgcttggactttctgttctttagagtaagaagtgatcaccatttcctgcttctttgtttctccacaactgtgcagtggatgcctgtttgttttctgccctcagaac

SEQ ID NO: 306303 - DNA, 1251 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgtaagtgtcgcatacacactatctctgcctccagctcctatgggggacagctctacagcactggggcaggggagagaagccatgtttagtaagtggtcacggcataaatgatatgcatgtggtaagctgggtcccaaggggctgattggctggactggaatggtcgcatgatgtagggggtaggcaggg

SEQ ID NO: 306304 - DNA, 937 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagttcaagtgccattcaatttatcctggcaagaagaggaaggcatcatcaagaccttaattttctaatacatctgatctgagaagaatgtgaaagctataaaattaatttttgatcaataactacaggccttttgagagagtgccctcctaatgaattgagtacctatttctccatacacagtgtctatcatgacctacaaacccttttcccatgaggtgtaacagagagagattacagccttggaactggatgtcagactctcctggtttaagacaataagccatgacatagagcctgaaaccaacacaatcttccgagtggttccagaaacatataggggataatg

SEQ ID NO: 306305 - DNA, 808 bp, Homo sapiens
gaaaacaggctgggcccggtggctcactcctgtaatcccagcactttgggaggttgaggtgggcggatcacctgaggtcaggagtttgagaccagccggcgggagtggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgccgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagttaatgatcctttgcctggactttctaagtgcccagaagagcaacagccagcatgcaggatggcattcctgaccagttgcacttggcctagcattccaacctcacctgcctcagcttgttcaacctgaaaacctaccaagtgaaagcaagagccacgtgaagacgccttagttatatgcacccacccagacacttgctcagaaaggaatcagtgggg

SEQ ID NO: 306306 - DNA, 388 bp, Homo sapiens
tgatgccataacaacccagagagcaactatttctagtgatttttaaatgcagctatttgaccttccattcctagtgggatacatcttaaggacaggattaattttaaaaatcttaaactgttttcactagccttctaattgatttttagcatagaaaaagggatatacagacattggatcaatggcatcaagtaaaaaccctgaagtcctaaatttgagttagaactatcctaaacacccatgatgtgtttcacattttaaaaatatttccggccgggcatggtggctcacacctgtaatcccagcaatttgagaggccgaggtgggcatatcacttgaggtcaggagttcaagaccagcctcgccaacatgatgaaaccccaccttt

SEQ ID NO: 306307 - DNA, 5877 bp, Homo sapiens
  misc_feature (2)..(2): n is a, c, g, or t
  misc_feature (7)..(7): n is a, c, g, or t
  misc_feature (10)..(10): n is a, c, g, or t
  misc_feature (16)..(16): n is a, c, g, or t
gnatccnagntcagangaaagccccgagatcacagagacccggcgagatcacagagacccggcctgaaggaacgtggaaagaccaatgtacctgttttgaccggttgcctggagcaagaagttccagttggggagaattttcagaagataaagtcggagattgtggaaagacttgacttgcagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaa

SEQ ID NO: 306308 - DNA, 1273 bp, Homo sapiens
gtagaaaataagagatttattcccctttttaaatcaaaaccagattccatgcttcagccgccccctaacccgccagccccgcccccagggtttgtttttccatatttttgtatatattttagcgaagatggcaggtgagggaaggttatagtgctgtacctagtccacgaagtaaacagagaggttagggtgggtttacttatttataaggcgttcagcctctcagctgtttctccctcgttggcatttggaagcttgcagtccttcagggaagagacagatttggcaggaacgttctttgtgcccgcctcccttttctattttttatttttttacctggaatagggggcagatttataatgacagccttagggaagggggagaaaaagtttcagccggcacgacaatgcccgttttttccacagtccacactgtgccacaaacagctttggtgccactcggagcccgtcccccgtcccctccctctctctctgcaggctcgcactggcaggcggaggcacagttaaattccagcaccttctccacatacccccgaactactacgcgctattactacggctgccctccgttttcgcttcgcctcctccccttccgcagtctccctggaggagccccgcggcgcccgaggaagaggactgccagggaagggacagcgggcgcccagctccagcagggcttggggctttctgcatcccgcgcagtttctctgctccaggcacaaacgcggcccgagagccggcgccttgcagtcacacacggatccacgcatacagtagagctgtctagatccacattcttgcacaccgccccctcctccccccgcgctcccggagtcgctgagctgagcgagtgacaggcgcgtcccgccaacccgcgcccggacgggcagggaggagcggcgcgcggggccaactgcggcgcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaaggtaaatataacttacaactcttttctcctctttcccctcccttcggccgccccgctgcagccgccgctcagacccctccggcaccacgccgccttcgcccgggattatccattattatcctaattattatttattgtgcatgcaagg

SEQ ID NO: 306309 - DNA, 733 bp, Homo sapiens
acgggtgcagtgtgcctttaagaaaagaggtgcctcactaaacttcgctgtagttgtgtttcaccgtctcggtagggaaggaaagtgttaatttcttatttgtacactttttttccccgacttccttcctattcacttcattaaatctagaggcagttgagcatgggagccgtctgtatgttgaattagggctcgcactcttgcgcaacacgtcaccagtcggaaactgggggtttgcttctgtgatttatttcattattgtgctggtaaaaggtttggaagggaattctttttgggggtagtactttagcattgtgtagcaagttttggggttttttttgtgtgtgaccccccagcccccagcgctgagtttgagtcagttgagccagtttagtaaataattttttaaaataaaagaacagtttaaaatctccatgaataattttacttacatgcaggagtaatcttactctactctttatgtgcgaaaagcattgggaagtgtttagtgaattgatttccattagaaaaagacccttagaaatcacagaacataaagcactgcatatggatgtgtttggggtctttggggaggagggaagatgttttgtagctctctgcattcctgcataaaaccttagtttgaggggaataatggtcagtactttgtgtgtttccttgtaattccaaaacctaaatttaataagaatctgcacgtattagcagttgtaat

SEQ ID NO: 306310 - DNA, 571 bp, Homo sapiens
tccccaaacagattctagtcttcctatgctgttaaacacacactgagagttttcttggacaacactgatagctcagaggacactggtcattggattttaagtatccttttcttccctttttggatcttctaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaaggtgcgtatcctagtggtggtggctgagtccagggtgtatgggcagggataagtttttaaggcgagtattgctctttaagtactacttcttacac

SEQ ID NO: 306311 - DNA, 473 bp, Homo sapiens
ctagtacggtgatgctttggtgggctgatttgtgctttttctttcaaaagatctggccaacttcttctctctacatctgagcctcttcatccagtttgctacactcctaccagtcaaaatgcagactgtcaaggggaggacagagtggagagtggagttgtctgcacgcttatattatgctctcatcctgctcttctttccttaataggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaaggtgcgtatcctagtggtggtggctgagtccagggtgtatgggcagggataagtttttaaggcgagtattgctctttaagtactacttcttacac

SEQ ID NO: 306312 - DNA, 556 bp, Homo sapiens
acgggtgcagtgtgcctttaagaaaagaggtgcctcactaaacttcgctgtagttgtgtttcaccgtctcggtagggaaggaaagtgttaatttcttatttgtacactttttttccccgacttccttcctattcacttcattaaatctagaggcagttgagcatgggagccgtctgtatgttgaattagggctcgcactcttgcgcaacacgtcaccagtcggaaactgggggtttgcttctgtgatttatttcattattgtgctggtaaactgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcgaagatgtggaccccaaactgacaaagcaaatgaaccctatcattgatactgtgataaactacgatagtttatggcgacagctcactggtcttcattcgt

SEQ ID NO: 306313 - DNA, 345 bp, Homo sapiens
gcacatctgtgaactgtatttggttgtaaagttttgtcatgtacatcatgtactaaaccgtgagagttaatcatcccaagaagattactgtaataaaccataattactttcagatagtgaaatccagaagaaaattgttaattatcatattgcaaggtttctgatgagagtaatacaaatgacaaatatcacacattctgcgtgctgctgactggctcgctgtgggctgctactgtgctgactgttcctgcaaagtcaggcaattacccggatgcccggggctgcctgctgtactttctcaacagaactggagcctttcagcagagcggtgggttctctactacc

SEQ ID NO: 306314 - DNA, 5851 bp, Homo sapiens
aaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggagtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306315 - DNA, 5901 bp, Homo sapiens
aaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggagtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaa

SEQ ID NO: 306316 - DNA, 5930 bp, Homo sapiens
aaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggagtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaaaaaaaaaaaaaaacaca

SEQ ID NO: 306317 - DNA, 5880 bp, Homo sapiens
aaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggagtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaaaaaaaaaaaaaaaaaaaaaaaaaaacaca

SEQ ID NO: 306318 - DNA, 5796 bp, Homo sapiens
aaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggagtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaagcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306319 - DNA, 6716 bp, Homo sapiens
gtagaaaataagagatttattcccctttttaaatcaaaaccagattccatgcttcagccgccccctaacccgccagccccgcccccagggtttgtttttccatatttttgtatatattttagcgaagatggcaggtgagggaaggttatagtgctgtacctagtccacgaagtaaacagagaggttagggtgggtttacttatttataaggcgttcagcctctcagctgtttctccctcgttggcatttggaagcttgcagtccttcagggaagagacagatttggcaggaacgttctttgtgcccgcctcccttttctattttttatttttttacctggaatagggggcagatttataatgacagccttagggaagggggagaaaaagtttcagccggcacgacaatgcccgttttttccacagtccacactgtgccacaaacagctttggtgccactcggagcccgtcccccgtcccctccctctctctctgcaggctcgcactggcaggcggaggcacagttaaattccagcaccttctccacatacccccgaactactacgcgctattactacggctgccctccgttttcgcttcgcctcctccccttccgcagtctccctggaggagccccgcggcgcccgaggaagaggactgccagggaagggacagcgggcgcccagctccagcagggcttggggctttctgcatcccgcgcagtttctctgctccaggcacaaacgcggcccgagagccggcgccttgcagtcacacacggatccacgcatacagtagagctgtctagatccacattcttgcacaccgccccctcctccccccgcgctcccggagtcgctgagctgagcgagtgacaggcgcgtcccgccaacccgcgcccggacgggcagggaggagcggcgcgcggggccaactgcggcgcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306320 - DNA, 6462 bp, Homo sapiens
gtagaaaataagagatttattcccctttttaaatcaaaaccagattccatgcttcagccgccccctaacccgccagccccgcccccagggtttgtttttccatatttttgtatatattttagcgaagatggcaggtgagggaaggttatagtgctgtacctagtccacgaagtaaacagagaggttagggtgggtttacttatttataaggcgttcagcctctcagctgtttctccctcgttggcatttggaagcttgcagtccttcagggaagagacagatttggcaggaacgttctttgtgcccgcctcccttttctattttttatttttttacctggaatagggggcagatttataatgacagccttagggaagggggagaaaaagtttcagccggcacgacaatgcccgttttttccacagtccacactgtgccacaaacagctttggtgccactcggagcccgtcccccgtcccctccctctctctctgcaggctcgcactggcaggcggaggcacagttaaattccagcaccttctccacatacccccgaactactacgcgctattactacggctgccctccgttttcgcttcgcctcctccccttccgcagtctccctggaggagccccgcggcgcccgaggaagaggactgccagggaagggacagcgggcgcccagctccagcagggcttggggctttctgcatcccgcgcagtttctctgctccaggcacaaacgcggcccgagagccggcgccttgcagtcacacacggatccacgcatacagtagagctgtctagatccacattcttgcacaccgccccctcctccccccgcgctcccggagtcgctgagctgagcgagtgacaggcgcgtcccgccaacccgcgcccggacgggcagggaggagcggcgcgcggggccaactgcggcgcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306321 - DNA, 4259 bp, Homo sapiens
tactgaggggacatatcctagggttttcaaataaaacaatcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306322 - DNA, 6488 bp, Homo sapiens
gtagaaaataagagatttattcccctttttaaatcaaaaccagattccatgcttcagccgccccctaacccgccagccccgcccccagggtttgtttttccatatttttgtatatattttagcgaagatggcaggtgagggaaggttatagtgctgtacctagtccacgaagtaaacagagaggttagggtgggtttacttatttataaggcgttcagcctctcagctgtttctccctcgttggcatttggaagcttgcagtccttcagggaagagacagatttggcaggaacgttctttgtgcccgcctcccttttctattttttatttttttacctggaatagggggcagatttataatgacagccttagggaagggggagaaaaagtttcagccggcacgacaatgcccgttttttccacagtccacactgtgccacaaacagctttggtgccactcggagcccgtcccccgtcccctccctctctctctgcaggctcgcactggcaggcggaggcacagttaaattccagcaccttctccacatacccccgaactactacgcgctattactacggctgccctccgttttcgcttcgcctcctccccttccgcagtctccctggaggagccccgcggcgcccgaggaagaggactgccagggaagggacagcgggcgcccagctccagcagggcttggggctttctgcatcccgcgcagtttctctgctccaggcacaaacgcggcccgagagccggcgccttgcagtcacacacggatccacgcatacagtagagctgtctagatccacattcttgcacaccgccccctcctccccccgcgctcccggagtcgctgagctgagcgagtgacaggcgcgtcccgccaacccgcgcccggacgggcagggaggagcggcgcgcggggccaactgcggcgcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306323 - DNA, 2432 bp, Homo sapiens
tctgacattggacattggtgtcttgtttaatgttttagatatggactaaatctgatggggaacctagagacagataaaaacaatatgatacctggatttcaaaacctgagatgtatttcagttggcttggttaatttcaacccaggtttcttcaactaggaatgacactgaatttttccaaacgtagcttgtgtgtttttaaaatgtaggcaaaatcttaccttagtgaaggtgaaatacagaacccttccatatttccctctggggtggggtccggttttggatgcctatgccaggcatctcagtcctcatagcatattgaccccccaaacaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306324 - DNA, 5661 bp, Homo sapiens
gtagaaaataagagatttattcccctttttaaatcaaaaccagattccatgcttcagccgccccctaacccgccagccccgcccccagggtttgtttttccatatttttgtatatattttagcgaagatggcaggtgagggaaggttatagtgctgtacctagtccacgaagtaaacagagaggttagggtgggtttacttatttataaggcgttcagcctctcagctgtttctccctcgttggcatttggaagcttgcagtccttcagggaagagacagatttggcaggaacgttctttgtgcccgcctcccttttctattttttatttttttacctggaatagggggcagatttataatgacagccttagggaagggggagaaaaagtttcagccggcacgacaatgcccgttttttccacagtccacactgtgccacaaacagctttggtgccactcggagcccgtcccccgtcccctccctctctctctgcaggctcgcactggcaggcggaggcacagttaaattccagcaccttctccacatacccccgaactactacgcgctattactacggctgccctccgttttcgcttcgcctcctccccttccgcagtctccctggaggagccccgcggcgcccgaggaagaggactgccagggaagggacagcgggcgcccagctccagcagggcttggggctttctgcatcccgcgcagtttctctgctccaggcacaaacgcggcccgagagccggcgccttgcagtcacacacggatccacgcatacagtagagctgtctagatccacattcttgcacaccgccccctcctccccccgcgctcccggagtcgctgagctgagcgagtgacaggcgcgtcccgccaacccgcgcccggacgggcagggaggagcggcgcgcggggccaactgcggcgcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaaaaaaaaaaaaaaaaaaaaaaaaaaacaca

SEQ ID NO: 306325 - DNA, 1940 bp, Homo sapiens
acgggtgcagtgtgcctttaagaaaagaggtgcctcactaaacttcgctgtagttgtgtttcaccgtctcggtagggaaggaaagtgttaatttcttatttgtacactttttttccccgacttccttcctattcacttcattaaatctagaggcagttgagcatgggagccgtctgtatgttgaattagggctcgcactcttgcgcaacacgtcaccagtcggaaactgggggtttgcttctgtgatttatttcattattgtgctggtaaactgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306326 - DNA, 1975 bp, Homo sapiens
acgggtgcagtgtgcctttaagaaaagaggtgcctcactaaacttcgctgtagttgtgtttcaccgtctcggtagggaaggaaagtgttaatttcttatttgtacactttttttccccgacttccttcctattcacttcattaaatctagaggcagttgagcatgggagccgtctgtatgttgaattagggctcgcactcttgcgcaacacgtcaccagtcggaaactgggggtttgcttctgtgatttatttcattattgtgctggtaaactgatgaagagactagcagctcgctgctttgctggcttgttaattttatccccactaactgtgatttctgatagccggcctgctgatagtggtaagtgctgctggctctggtttaaagcaagcgtttgcaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306327 - DNA, 1607 bp, Homo sapiens
agattcagtagaactacatcccaggcatgtgtaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306328 - DNA, 1769 bp, Homo sapiens
ttaaagatgcatttatccaatatggtagcattccttttttcttcttcctccactgattactgttaacttttacttttttttggttaatttctttcattttattctaattgttggagctatatataaatatacacatactttttttgtcttggttattctcttgtcttgaatttgtctcctttgtttccaacgaacagccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306329 - DNA, 1933 bp, Homo sapiens
acgggtgcagtgtgcctttaagaaaagaggtgcctcactaaacttcgctgtagttgtgtttcaccgtctcggtagggaaggaaagtgttaatttcttatttgtacactttttttccccgacttccttcctattcacttcattaaatctagaggcagttgagcatgggagccgtctgtatgttgaattagggctcgcactcttgcgcaacacgtcaccagtcggaaactgggggtttgcttctgtgatttatttcattattgtgctggtaaatgctgctggctctggtttaaagcaagcgtttgcaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306330 - DNA, 1838 bp, Homo sapiens
cttggagaggcggaggtggaaacgatgcgcaggagttggcttggggctttttgtttgcgtgtccctgtttacctattcataatcatggatcccctctgctttgtgatactgtgaaccacgcataacagcaattctttacaccaccgggttgagaagaaggcgcctgaggctgactttctggacctgccgtcacgcagtaaagatgtggttggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306331 - DNA, 1446 bp, Homo sapiens
aaacttacaaaagagtagggtgtagacgtgggacgaaaggggtcgcccccaagctaactatcagtcaagttatgggcaaatagaaggaaacttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306332 - DNA, 1183 bp, Homo sapiens
gaaaggggtcgctgactagacagaaccacacagaacaggcataaaccgggaatgttctgggcactctgggatgtttgtgttgtctgtaggttggtgatagtcttaccacctatacaaagatctccttgtgattactcactggtgtctatttcatttgctttggttttagcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 306333 - DNA, 5772 bp, Homo sapiens
gtagaaaataagagatttattcccctttttaaatcaaaaccagattccatgcttcagccgccccctaacccgccagccccgcccccagggtttgtttttccatatttttgtatatattttagcgaagatggcaggtgagggaaggttatagtgctgtacctagtccacgaagtaaacagagaggttagggtgggtttacttatttataaggcgttcagcctctcagctgtttctccctcgttggcatttggaagcttgcagtccttcagggaagagacagatttggcaggaacgttctttgtgcccgcctcccttttctattttttatttttttacctggaatagggggcagatttataatgacagccttagggaagggggagaaaaagtttcagccggcacgacaatgcccgttttttccacagtccacactgtgccacaaacagctttggtgccactcggagcccgtcccccgtcccctccctctctctctgcaggctcgcactggcaggcggaggcacagttaaattccagcaccttctccacatacccccgaactactacgcgctattactacggctgccctccgttttcgcttcgcctcctccccttccgcagtctccctggaggagccccgcggcgcccgaggaagaggactgccagggaagggacagcgggcgcccagctccagcagggcttggggctttctgcatcccgcgcagtttctctgctccaggcacaaacgcggcccgagagccggcgccttgcagtcacacacggatccacgcatacagtagagctgtctagatccacattcttgcacaccgccccctcctccccccgcgctcccggagtcgctgagctgagcgagtgacaggcgcgtcccgccaacccgcgcccggacgggcagggaggagcggcgcgcggggccaactgcggcgcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaaggtcgctactccaggtggagtcagctggtcgtcagaaatgcagaagtctgaaaagacatctcaagacaccaatcttaggttctacgatagtaatattgtctacaggagtaactggggaagtcacaaatcttgtaacatcagggaaaaatacctggttattgtttcacttacatacatcttagcagaattcaggcccctctcataatcctaacctgtgggctttcattagttttacaaaggttgtttagttttgggaagggctattatcatccttgcatgaaggttaaactacaaactaaatttctcccaaagttagcttgacctattcccaggaatgactaaggacagcttggcagtcagaagcaaaatggagtcaactatgtcagatttctcttactgtcgtaatttgcaaaggcggttttgctactttccttgcaaattagttggggacttcagcagttctgcatagaccaagaccaagagttttctagtactctcatcaagaagtcacctactctggtcccattttaaatcccctgcatactgtctagaagaatatataacagatgctaacaggatccaatttgttcattgaaatatatcaagttttctccaaattttcaagaccata

SEQ ID NO: 306334 - DNA, 5176 bp, Homo sapiens
gtagaaaataagagatttattcccctttttaaatcaaaaccagattccatgcttcagccgccccctaacccgccagccccgcccccagggtttgtttttccatatttttgtatatattttagcgaagatggcaggtgagggaaggttatagtgctgtacctagtccacgaagtaaacagagaggttagggtgggtttacttatttataaggcgttcagcctctcagctgtttctccctcgttggcatttggaagcttgcagtccttcagggaagagacagatttggcaggaacgttctttgtgcccgcctcccttttctattttttatttttttacctggaatagggggcagatttataatgacagccttagggaagggggagaaaaagtttcagccggcacgacaatgcccgttttttccacagtccacactgtgccacaaacagctttggtgccactcggagcccgtcccccgtcccctccctctctctctgcaggctcgcactggcaggcggaggcacagttaaattccagcaccttctccacatacccccgaactactacgcgctattactacggctgccctccgttttcgcttcgcctcctccccttccgcagtctccctggaggagccccgcggcgcccgaggaagaggactgccagggaagggacagcgggcgcccagctccagcagggcttggggctttctgcatcccgcgcagtttctctgctccaggcacaaacgcggcccgagagccggcgccttgcagtcacacacggatccacgcatacagtagagctgtctagatccacattcttgcacaccgccccctcctccccccgcgctcccggagtcgctgagctgagcgagtgacaggcgcgtcccgccaacccgcgcccggacgggcagggaggagcggcgcgcggggccaactgcggcgcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggtctgcatgtcccactcaggtgcccaggcctccctctggagagcaactaaaagatgatcagtttcattattcacatttacaggacagagcaaatatctaaacgagtgggctgttgctttcttggagccaattcttctggctgttttcttatctcccttagagcatagatacgaggtcccacatatgcctttgaagagctgaagtttgaggtagaaaaacttagtttctccttagttttaatcccatctcttgggattgccattgaacaaagtatatttaatgagggataagtcaaaaatgttgcaaaatcatagcagtaagaacaatagcaaccatcattcatgggacccttaatctgtgtcagcctcttgggcattttttcattcagttttacgacaaccctgtcagacggttaatatgatttgaatctttgcagtcaaggaaactgaatcctaggcagggtaagtaacttccccaaggccaaatagtattacagtagttaaccttttattttgtgttttatttaaagtcatcatcaaaacatattctaatgagcat

SEQ ID NO: 306335 - DNA, 1007 bp, Homo sapiens
acgggtgcagtgtgcctttaagaaaagaggtgcctcactaaacttcgctgtagttgtgtttcaccgtctcggtagggaaggaaagtgttaatttcttatttgtacactttttttccccgacttccttcctattcacttcattaaatctagaggcagttgagcatgggagccgtctgtatgttgaattagggctcgcactcttgcgcaacacgtcaccagtcggaaactgggggtttgcttctgtgatttatttcattattgtgctggtaaactgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgagggtaagcccagacattcgggtcctgtac

SEQ ID NO: 306336 - DNA, 588 bp, Homo sapiens
acgggtgcagtgtgcctttaagaaaagaggtgcctcactaaacttcgctgtagttgtgtttcaccgtctcggtagggaaggaaagtgttaatttcttatttgtacactttttttccccgacttccttcctattcacttcattaaatctagaggcagttgagcatgggagccgtctgtatgttgaattagggctcgcactcttgcgcaacacgtcaccagtcggaaactgggggtttgcttctgtgatttatttcattattgtgctggtaaactgatgaagagactagcagctcgctgctttgctggcttgttaattttatccccactaactgtgatttctgatagccggcctgctgatagtggtaagtgctgctggctctggtttaaagcaagcgtttgcaggtaattggaaaaaagtgtttattgtttgtgagtgtgtgtgttctttatcgaatgatttaagtgcgtttaccaaggaatgtggctttgtactttcccgtttccttgtttactaattgccacgttagaacaaaaatctagatggaattttgatttatattgttaatcatgaataaattgatgcaaaac

SEQ ID NO: 306337 - DNA, 418 bp, Homo sapiens
ggcagccctcgcccgtcctccagctgcagcagaagcagagccgcatcagccccatccagaaaccgcaaggcctggaccccgtggaaattctgcaagagcgggaatacaggtaacgcaccccgccagcaaggggccccctgcggtgtgctagcacctgccgcccaagccgaggggggtgaggcgcctgcctccttggttggccaaactgtgattttcacccgtgcggtcggaaaactttcatccactcctggggccttcccggtgctgaggggaggcaccggggttttgaagatcaaaagccgacggggacttcctgtggacccgagagagtgatcatctcacactgcgactgtggaatacactgtccgtgtttgtgcttgtgcggttcggtgatgacggaggggctgggacgctgagt

SEQ ID NO: 306338 - DNA, 381 bp, Homo sapiens
agcacccaaagcaagtcagctggacgcctggctggaaatgaatcctgggtaaggcatgaaagcagcgttcatggtgttcttttagctttttagattttggtaatcttgtacgatctcgaaactaaaactacacagcctttgctgagatggttgaagttgttacttggatttgtcttttatacatagaatgtgctattaagtcatgtgtgtctttattgtattgtaatttaaaaaactaagccccctcctcttcctcactctttttccttagttatgaagttgcccctagatctgacagtgaagagagtgattctgattatgaggaagaggtatgtatgtatctctgtttggggtttattggtttgaaagttatcagaggaa

SEQ ID NO: 306339 - DNA, 408 bp, Homo sapiens
ctctctatatttatgtattctttagtttttttcttacaagatttttttatgaaccacaaacttgtcatgttttgtgacagtttgttttgaacttatctcctatttccacacctttaaaataaatatcttgttgagatatgttatattctgtagcccctttcaaggtgaggcctgaacatgaataagaacatctttttaaccattgatttttatacaaatgtcttttttctgttgttttttttttttgttccataggactctatctaactggacatatgaatttgacaaatgggctccttctgtggtgaagatttcttacaaggtttggaatgctgtatttatatataaatgtggaaaagcaaaaaatagaccctattttcttcattccatatgcacatctgtgaactg

SEQ ID NO: 306340 - DNA, 276 bp, Homo sapiens
cctggttgtttttatagctattttattatctctctgcattagtgctgctggctctggtttaaagcaagcgtttgcaggtaattggaaaaaagtgtttattgtttgtgagtgtgtgtgttctttatcgaatgatttaagtgcgtttaccaaggaatgtggctttgtactttcccgtttccttgtttactaattgccacgttagaacaaaaatctagatggaattttgatttatattgttaatcatgaataaattgatgcaaaacctgaagaaaaggt

SEQ ID NO: 306341 - DNA, 371 bp, Homo sapiens
gtagcgtaagttaatcacaagaaagacattatgtctaactcaggaactgctatataattaaagaagctttgaaccacaaggtgtgtaggtgactgaaaaaacctatggtcctttgtcctttgtataagaagcccagtgtgaaggatctgaaatgtctgaccagttaataattaattctatttttccctttccactggttcttaggggaaaggaggtgctaagacacttatgaacactattatgcagttgagaaaaatctgcaaccacccatatatgtttcagcacattgaggtaagtctgtattgtgtgttttgagcctgattgtgctaatcatactaatgctagttaaaaaaaaacaaacaaacaggaaa

SEQ ID NO: 306342 - DNA, 413 bp, Homo sapiens
ataataagcctctcttacaggtggacttaaatgaagaagaaactatattgatcatcaggcgtctacataaggtgttaagaccatttttactaaggagactgaagaaagaagttgaatcccagcttcccgaaaaagtatgttgcacaaccaaaagttgtgggttttttttttcctccagcaaatatatttgaagtacctgcctctgaaattgtgtttctgaaacagcagactcatattgtagttaatagtatcttgaaaatatcttaaattgtttttttgtttgatagggctagagagagcagggaaattatagcatttgcagcctgttttccaaaagcgttcgagcagattttatgaaattatcaaattcactgagtctcatttacattttaattttagattttttttttttt

SEQ ID NO: 306343 - DNA, 162 bp, Homo sapiens
tggaaaaagctaagaagagaagaggccgccctcccgctgagaaactgtcaccaaatccccccaaactgacaaagcagatgaacgctatcatcgatactgtgataaactacaaagataggtgagtgtttggttccttcaccttgatcatctctcaccaagacg

SEQ ID NO: 306344 - DNA, 842 bp, Homo sapiens
tggaattcggacccgagtagcataactcagtctagtgtgctatgtctgactgggcagcaaggtagaagagtgggcagaagctcctaataccttgccttttgaaatacccttcatttcatccattcactttccagaggatggtttcctggcacccacattattttctttctggaaagataaatttcccttttcctagtttgattttccttcaacacattaccattttggtaaaatttcagaattatgatctcaccccagccttaacccttgatgcaagcattttcaaatacatttttctttaggagatgtcaaatgcagggtatttttttttctcccatgaattttctaaaacctggggctgaaaaagagaaaatattagccataaacctttcaagccaaagtgaaagggcacaaacaatagcttagagggtgggctttgctttggggtttttcagtaagaaaaacttctcagcttagagactgtcgatgcctctttaatgtgtttctgtcctcccacggaaagagatttggcgagttgtttccaaaatgtcattttttcctactggcctcttgatggtttgttgttatatcttctttttcttgcatgtgatgttacttcattttatcttcttatttttacttttaggaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatg

SEQ ID NO: 306345 - DNA, 4106 bp, Homo sapiens
gccgggagggcgggctcggctccccggaagaagggagtgggaaggcggccaaaggggctgaaggggcgggccgggccggcttgggaggggacgcggagggggcgggccgggctgcgttcgctccagccgcggctctacagcagcgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctagatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgcaaa

SEQ ID NO: 306346 - DNA, 717 bp, Homo sapiens
  misc_feature (101)..(101): n is a, c, g, or t
taccgcatccgaacgatcccaagcgaattacccctttaggaacaaactgagtcacgcgttcggcgtttagccgccgatcccggctcaagattgggacaacncggctttcacacgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctagatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaagg

SEQ ID NO: 306347 - DNA, 252 bp, Homo sapiens
ataacaaagtgcaatagacctagtagcttatacacaatagaaatatctttctcacagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaagg

SEQ ID NO: 306348 - DNA, 3838 bp, Homo sapiens
gccgggagggcgggctcggctccccggaagaagggagtgggaaggcggccaaaggggctgaaggggcgggccgggccggcttgggaggggacgcggagggggcgggccgggctgcgttcgctccagccgcggctctacagcagcgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctagatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgcaaa

SEQ ID NO: 306349 - DNA, 2308 bp, Homo sapiens
ggtcaggcactgaagcctggtcaggcactgaagcctggtcaggcactgaagcctggtcaggcactgaagcctggtcaggcactgaagcctggtcaggcactgaagcctggtcaggcactgaagcccggtcaggcactgaagcctggtcaggcactgaggcctggtcaggcactgaagcctggtcaggcactgaagcctggtcaggcactgaagcctggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgcaaa

SEQ ID NO: 306350 - DNA, 3118 bp, Homo sapiens
gccgggagggcgggctcggctccccggaagaagggagtgggaaggcggccaaaggggctgaaggggcgggccgggccggcttgggaggggacgcggagggggcgggccgggctgcgttcgctccagccgcggctctacagcagcgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctagatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcctccgcctctccaccagccccctcctcattaaagggaaagaagggaatttgcaaa

SEQ ID NO: 306351 - DNA, 600 bp, Homo sapiens
  misc_feature (101)..(101): n is a, c, g, or t
taccgcatccgaacgatcccaagcgaattacccctttaggaacaaactgagtcacgcgttcggcgtttagccgccgatcccggctcaagattgggacaacncggctttcacacgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctagatcaacaagcaaaggaggtgccaagcctgtttgtcttcattgtgacactggagggtggctgttggaggaagggaggagagtaaatgaagagaaagaactggaataaccccttgcagaaaaaaaaaaaaagg

SEQ ID NO: 306352 - DNA, 6231 bp, Homo sapiens
agcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgaccaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatccaaaacttcttgaagacttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgaaaaaaaa

SEQ ID NO: 306353 - DNA, 6601 bp, Homo sapiens
  misc_feature (522)..(522): n is a, c, g, or t
  misc_feature (528)..(528): n is a, c, g, or t
  misc_feature (530)..(530): n is a, c, g, or t
  misc_feature (533)..(533): n is a, c, g, or t
  misc_feature (3651)..(3651): n is a, c, g, or t
  misc_feature (3691)..(3691): n is a, c, g, or t
  misc_feature (3695)..(3696): n is a, c, g, or t
  misc_feature (3813)..(3814): n is a, c, g, or t
  misc_feature (3838)..(3838): n is a, c, g, or t
  misc_feature (3840)..(3840): n is a, c, g, or t
  misc_feature (3859)..(3859): n is a, c, g, or t
agcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgaccaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcnaaaacntnttnaagcttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctganacctatgccaatatcagttgggaatatgagggaccagagnatgnnaacttttatgttgaatatggtgtagcaggcagcaaagaagaatggagaaaagaaattgtaaatggttctcggagcttctttgggttaaagggtctaatgccaggaacagcatacaannttcgagttggtgctgtgggggacncnggtttgtgagttcagaggntgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgaaaaaaaa

SEQ ID NO: 306354 - DNA, 6462 bp, Homo sapiens
  misc_feature (522)..(522): n is a, c, g, or t
  misc_feature (528)..(528): n is a, c, g, or t
  misc_feature (530)..(530): n is a, c, g, or t
  misc_feature (533)..(533): n is a, c, g, or t
  misc_feature (3651)..(3651): n is a, c, g, or t
  misc_feature (3691)..(3691): n is a, c, g, or t
  misc_feature (3695)..(3696): n is a, c, g, or t
  misc_feature (3813)..(3814): n is a, c, g, or t
  misc_feature (3838)..(3838): n is a, c, g, or t
  misc_feature (3840)..(3840): n is a, c, g, or t
  misc_feature (3859)..(3859): n is a, c, g, or t
agcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgaccaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcnaaaacntnttnaagcttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctganacctatgccaatatcagttgggaatatgagggaccagagnatgnnaacttttatgttgaatatggtgtagcaggcagcaaagaagaatggagaaaagaaattgtaaatggttctcggagcttctttgggttaaagggtctaatgccaggaacagcatacaannttcgagttggtgctgtgggggacncnggtttgtgagttcagaggntgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagtt

SEQ ID NO: 306355 - DNA, 6547 bp, Homo sapiens
  misc_feature (522)..(522): n is a, c, g, or t
  misc_feature (528)..(528): n is a, c, g, or t
  misc_feature (530)..(530): n is a, c, g, or t
  misc_feature (533)..(533): n is a, c, g, or t
  misc_feature (3651)..(3651): n is a, c, g, or t
  misc_feature (3691)..(3691): n is a, c, g, or t
  misc_feature (3695)..(3696): n is a, c, g, or t
  misc_feature (3813)..(3814): n is a, c, g, or t
  misc_feature (3838)..(3838): n is a, c, g, or t
  misc_feature (3840)..(3840): n is a, c, g, or t
  misc_feature (3859)..(3859): n is a, c, g, or t
agcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgaccaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcnaaaacntnttnaagcttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctganacctatgccaatatcagttgggaatatgagggaccagagnatgnnaacttttatgttgaatatggtgtagcaggcagcaaagaagaatggagaaaagaaattgtaaatggttctcggagcttctttgggttaaagggtctaatgccaggaacagcatacaannttcgagttggtgctgtgggggacncnggtttgtgagttcagaggntgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgaaaaaaaa

SEQ ID NO: 306356 - DNA, 6544 bp, Homo sapiens
  misc_feature (522)..(522): n is a, c, g, or t
  misc_feature (528)..(528): n is a, c, g, or t
  misc_feature (530)..(530): n is a, c, g, or t
  misc_feature (533)..(533): n is a, c, g, or t
  misc_feature (3651)..(3651): n is a, c, g, or t
  misc_feature (3691)..(3691): n is a, c, g, or t
  misc_feature (3695)..(3696): n is a, c, g, or t
  misc_feature (3813)..(3814): n is a, c, g, or t
  misc_feature (3838)..(3838): n is a, c, g, or t
  misc_feature (3840)..(3840): n is a, c, g, or t
  misc_feature (3859)..(3859): n is a, c, g, or t
agcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgaccaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcnaaaacntnttnaagcttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctganacctatgccaatatcagttgggaatatgagggaccagagnatgnnaacttttatgttgaatatggtgtagcaggcagcaaagaagaatggagaaaagaaattgtaaatggttctcggagcttctttgggttaaagggtctaatgccaggaacagcatacaannttcgagttggtgctgtgggggacncnggtttgtgagttcagaggntgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagatttcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgaaaaaaaa

SEQ ID NO: 306357 - DNA, 6213 bp, Homo sapiens
agcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgaccaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgaaaaaaaa

SEQ ID NO: 306358 - DNA, 6193 bp, Homo sapiens
agcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgaccaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacaagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgaaaaaaaa

SEQ ID NO: 306359 - DNA, 3891 bp, Homo sapiens
accgtctgaccggagtcccggcaggcgatgacaacaggtagtccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgaaaaaaaa

SEQ ID NO: 306360 - DNA, 5765 bp, Homo sapiens
  misc_feature (522)..(522): n is a, c, g, or t
  misc_feature (528)..(528): n is a, c, g, or t
  misc_feature (530)..(530): n is a, c, g, or t
  misc_feature (533)..(533): n is a, c, g, or t
  misc_feature (3651)..(3651): n is a, c, g, or t
  misc_feature (3691)..(3691): n is a, c, g, or t
  misc_feature (3695)..(3696): n is a, c, g, or t
  misc_feature (3813)..(3814): n is a, c, g, or t
  misc_feature (3838)..(3838): n is a, c, g, or t
  misc_feature (3840)..(3840): n is a, c, g, or t
  misc_feature (3859)..(3859): n is a, c, g, or t
agcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgaccaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcnaaaacntnttnaagcttggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagtggatgaattgaatgacactatagctgctaatttgagtgacactgagttttatggtgctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaattgcccctgatgaccccagcagaaaaatagatggcgataccattattttttcaaatgttcaagaaagatcaagtgcagtctatcagtgcaatgcctctaatgaatatggatatttactggcaaacgcatttgtaaatgtgctggctgagccaccacgaatcctcacacctgcaaacacactctaccaggtcattgcaaacaggcctgctttactagactgtgccttctttgggtctcctctcccaaccatcgagtggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcgaagaatgaagttcacttagaaatcaaagatcctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggttcactgttgacaaggatcatctagtggtagctgatgtcagtgacgatgacagcgggacctacacgtgtgtggccaacaccactctggacagcgtctccgccagcgctgtgcttagcgttgttgctcctactccaactccagctcccgtttacgatgtcccaaatcctccctttgacttagaactgacagatcaacttgacaaaagtgttcagctgtcatggaccccaggcgatgacaacaatagccccattacaaaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcgtctgagcagtatttgacgaaagcctcagaaccagataaaaaccccacagctgtggaaggactgggatcagagcctgataatttggtgattacgtggaagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagacctcccaatggtggctcctgggaacgtgcgtgtgaatgtggtgaacagtaccttagccgaggtgcactgggacccagtacctctgaaaagcatccgaggacacctacaaggctatcggatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggagtccccagtgctccctcgtctttgaagattgtgaatccaacactggactctctcactttggaatgggatccaccgagccacccgaatggcattttgacagagtacaccttaaagtatcagccaattaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaagctggtattcttccacctgatgtaggtgcaggcaaagttcaagcagtaaatcccaggatcagcaatcttactgctgcagctgctganacctatgccaatatcagttgggaatatgagggaccagagnatgnnaacttttatgttgaatatggtgtagcaggcagcaaagaagaatggagaaaagaaattgtaaatggttctcggagcttctttgggttaaagggtctaatgccaggaacagcatacaannttcgagttggtgctgtgggggacncnggtttgtgagttcagaggntgtgtttgagacaggcccagcgatggcaagccggcaggtggatattgcaactcagggctggttcattggtctgatgtgtgctgttgctctccttatcttaattttgctgattgtttgcttcatcagaagaaacaagggtggtaaatatccagttaaagaaaaggaagatgcccatgctgaccctgaaatccagcctatgaaggaagatgatgggacatttggagaatacagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagtt

SEQ ID NO: 306361 - DNA, 2821 bp, Homo sapiens
gaaaccgtttctacatggctggctctaagccagatgatatttcatagtgcaaagagggatagaacctcactggtggccaaatgtgattatatgctataaccctgtgcccctactctgacacccacccccaagcagttaccctctgttggaagcctgcagctttctttgtttgtttctttaattatacagacagtaggatctgcatccttactagcatatagaaaaatcagagaaacaatgcaaccaagagtgctgttttcatttgtttcttctgcatccttttaatggaattttgtaggtctcttgaaagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgaaaaaaaa

SEQ ID NO: 306362 - DNA, 1189 bp, Homo sapiens
taaaaccacatttaatttttaataccaaatctgttgcactattacagaagtgaccctttcatgcacagataaatttcgcatctaccagtatggaagaggaaaaaagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgaaaaaaaa

SEQ ID NO: 306363 - DNA, 1847 bp, Homo sapiens
agcttcgtcgagaacggaggacaccggcggtccagggtcctgggcagtcgcgccagagctgagcggagggcgcggcgcgagaacgaatctttgtgacattctctctcagcattctttatcccctgtttgctgaagacttcgaccaaagctggtcttagctgttggcattctcctgagaaaaggatagcttcagaaatcagaaaaacatttgggaggtgtctagcccagtggaccttctgaagagcaatgctaagaagacgtttggtttaaagaattaaaaggaagaacaacttaagagcttcttcaaagtttcccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatctggtacagcctccaaccatcacccaacagtctccaaaagattacattattgaccctcgggagaatattgtaatccagtgtgaagccaaagggaaaccgcccccaagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagatcaccattgtggaccaaagaaaaacttgaaccaatcacacttcaaagtggtcagtctttagtacttccctgcagacccccaattggattaccaccacctataatattttggatggataattcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcagctaaatcaagtagagagaggccaccaacatttttaactccagaaggcaatgcaagtaacaaagaggaattaagaggaaatgtgctttcactggagtgcattgcagaaggactgcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaagcggctccatactggatcacagcccctcaaaatcttgtgctgtccccaggagaggatgggaccttgatctgcagagctaatggcaaccccaaacccagaattagctggttaacaaatggagtcccaatagaaagtaagttgccttgagtggttctaattgcagtatattttcagagcatatatacatcccgacagtgaataaatggtgataaaaaaataactcaggttaaggaaggaagccacatgtatgttaaacacaggcaccaaattacctttgcattttattaccattagatatttattatgaatgtgaatagtttatgctgttaacataatggcatgtgatgactggtacttggcaatatttcgtctgctttttacatggataatgggaagaatgacagggtcagaaataaatatcacttcaaagttt

SEQ ID NO: 306364 - DNA, 516 bp, Homo sapiens
gtttgcttcatcagaagaaacaagggtggtaaatatccaggtaagaaagaaagattaaaattgctttataatgctacataataatccattaaactaaaaagatcatgggggaaatcatgtagattgtaatattttgtcttcccagagccatgagtttggactttctcttcaaatgacttttgatccctttttatataatggcaatctaaacattgtcaatgatcataaggcatttggaggagtaaatcaatcagttctctgaaaacattagtgagcctactttcttagactccacataggttatggatgctgaagtaacacctaaaaccaactggcaaggagagagttgcagggaaggttcatggagtttttcaaaggaagtaatgcatgaactaagtcttcatattgtgatgtgtaacattgctttccctataaggtaatggtttattcaatttagtgggcccattaaatttatattttctttacctgaccattttcccttcagtgacaagaaaa

SEQ ID NO: 306365 - DNA, 451 bp, Homo sapiens
tggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggaggtatggaatggacgtgtctctaagatctcaggaacatatggcatggcctgagaggttttgcctgacagaagggctactgatcaaagtatattctggaagccaaatgtgattgaaatttctatagatgaatacagcacacacaaagctaccaaaatgtcagatcatatgtgggcctaagtgtacatagaaggcttcagaacccaaaatgctgctctgaaatgccctctcccgtgacttaaaatttttctccacaca

SEQ ID NO: 306366 - DNA, 1125 bp, Homo sapiens
agcgggctcttaacccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaataca

SEQ ID NO: 306367 - DNA, 957 bp, Homo sapiens
agcgggctcttaacccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaataca

SEQ ID NO: 306368 - DNA, 999 bp, Homo sapiens
agcgggctcttaacccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaataca

SEQ ID NO: 306369 - DNA, 831 bp, Homo sapiens
agcgggctcttaacccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaataca

SEQ ID NO: 306370 - DNA, 1162 bp, Homo sapiens
  misc_feature (182)..(182): n is a, c, g, or t
aaggtggcttagagcatccagtcgagaggtctgggcgagagtctgaacggaaacattggttcagatgctagatggtcctagcgacgatcactgcctgcatagaggtacgccgcgtctaggcagtgtcgtacagcgcgagagtacaagaaacggctgcgcgcaggtgagactctgcatcggtncctttgcaacaaacttgacgcactgagatgtgccttgtatcgtcatttagatgtgattcattcagggagggcacttgctgtgcaatcctggatgagtcatcacttaccgtggctgccctggcccctggtccagggctgggtgatgttcgtgtctgtgttctgcttcgtggccaccaccaccttgatcatcctgtacataattggagcccacggtggagagacttcctgggtcaccttggacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaataca

SEQ ID NO: 306371 - DNA, 1052 bp, Homo sapiens
agcgggctcttaacccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaataca

SEQ ID NO: 306372 - DNA, 456 bp, Homo sapiens
gagctcggtaccccccccgagccaccgcccgccgccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaataca

SEQ ID NO: 306373 - DNA, 730 bp, Homo sapiens
aagcgtagcaatgaaccgagagaaattggcaagccgggggaatggactgatcaccaatgggagccaagtccgccagcctcgctccaagaagcccggagatcatgagcaccatctcaggtacacggagcacgacggtcaccttcactgttcgccccggcacctcccagcccatcaccctgcagagccggccccccgactatgaaagcaggacctcaggaacaagacgtgccccaagccctgtggtctcgccaacagagatgaacaaagagaccctgcccgcccccctgtcgggctagtcggggaggactagccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttcaataca

SEQ ID NO: 306374 - DNA, 330 bp, Homo sapiens
ccaccttgatcatcctgtacataattggagcccacggtggagagacttcctgggtcaccttggtgagtccagcccagggtggctgctggttgtaggggggcgcaggaagtactggtccctggcccagtaggatgggcttttccagtgccaggtgagacttctccgtagatgtcaccccaccatgttccaaggctgagcctgcccagggctcctggcagcagaatcaggagaggcaggggcagaggcaaggtcgccgctgccaaccctcactggacctgttctgtgttctcctgcatgactgcctttccatggataaccagctgcccagcc

SEQ ID NO: 306375 - DNA, 490 bp, Homo sapiens
gtgcttatgggtgcctggccctgggctgagtccttgatgtgcaaagggccttacaagaggttcaattcaactcagacttcataagaaagccaaagcctggttttatgattgcagccctcagcctgggctgcctgaagacgaagagaaagagcaaggttattgttggctcaggccttgttagccagacttcgtgctctgtacgcattcaatttcctcccctccaaacatcatccctgggaactgctgagttcagatagaatatatgttggtagtttgcagttgggttattatccatttgttcataaaaattaaccttttgtattaaaatttggtcagatagtattaatagaaagttcaggatgttaaacaacttggagtggtgttgcttttttttttataaaagtaaaatggacttttttttgtttgagaaatgtcttcaagttttgtgtgaataaaacactttagcagcatctgtataaatacaattgga

SEQ ID NO: 306376 - DNA, 1971 bp, Homo sapiens
  misc_feature (2)..(2): n is a, c, g, or t
  misc_feature (17)..(18): n is a, c, g, or t
  misc_feature (1204)..(1204): n is a, c, g, or t
gntttgaaggacagtanncgttttctcaatcacctaaacaacagacttggtgaccaaagaagggtgtattcatttccgtgtattgctgcttttgctgatgagcatgagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagaaacggagaagataaagatatttatcatttacctgaagaagcccatgattatcagctacaaagaagtcatgaaaatagaaatccattttgatttgcagttcaacatatcacaagtttccattcaagctttaggagaagacaaacagatgttgcctgaccagacgaaaatctcctcagaactttttagtaagtctgataaagaagacagggagagtcccagtggccttgaaagagaaacagagcaggcagaagaatccactaacatggtggagtttatgagtgctgaagatgaccgctgcctaataactctccacttaaatgaccaatctgagccacctgttattggggaacctgcctctgatagtcaccttcagccggtccctccgttcggggtccctgacttcccgcaacaacctaagtctcattacagaaaacatctcttctctgagagtaatcaagattcaagtaccagtgaactatcttggaccagtaaccagaaaaagaaatccctaaaatcatattccagtagaaagaagacaagaaccagaagtaatttgagaatcttgccagttttccctcccagtagtggcagtggccatgagaaagaccaagctaagcttctatcaccatcagagaaagaaatacccgagcaaaataacaccacatctccaaagacttctgaacaaaaattccaagatagttttgcttttttgactgctgaagattctgcccagaaaacagagcttcaagatcctcactcactgagtgagctctcttccttgaagcactcagaagatgaagaaaaacctaagattgtgaaccaagaatcactaacagaaagtactagcttgaaacataagctgagaaacttggaagacaaagacataccagaaggtagttttgctaagtcacaacaatcaagattggaagaagaggttgctncgggatcccctttctcaataacagaagaaagagagttgccagaaggaatttccacttcatccctagaagttgtgccagagaacttgaacggttctgccattctcccaacctttgaaaacttcactaaaaaacggaaaagaaaatatgagcttaggtacagaaagcgtccgtttaattcagaaaatgcaaagaaagcaccggattgcctaataaaacttttaaaccagatgcaactgttcagactcaataaactagagcgctttcaaaatttggttcttcaagagttgagcagtcttaagcaggatattcaggccctggaacaccttgagaaggaggttctggaattctgggggaaacagtctgctgatctgcaatctttctgtgatctgcaagtgctgaggttcaattcaactcagacttcataagaaagccaaagcctggttttatgattgcagccctcagcctgggctgcctgaagacgaagagaaagagcaaggttattgttggctcaggccttgttagccagacttcgtgctctgtacgcattcaatttcctcccctccaaacatcatccctgggaactgctgagttcagatagaatatatgttggtagtttgcagttgggttattatccatttgttcataaaaattaaccttttgtattaaaatttggtcagatagtattaatagaaagttcaggatgttaaacaacttggagtggtgttgcttttttttttataaaagtaaaatggacttttttttgtttg

SEQ ID NO: 306377 - DNA, 2035 bp, Homo sapiens
  misc_feature (2)..(2): n is a, c, g, or t
  misc_feature (17)..(18): n is a, c, g, or t
  misc_feature (1204)..(1204): n is a, c, g, or t
gntttgaaggacagtanncgttttctcaatcacctaaacaacagacttggtgaccaaagaagggtgtattcatttccgtgtattgctgcttttgctgatgagcatgagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagaaacggagaagataaagatatttatcatttacctgaagaagcccatgattatcagctacaaagaagtcatgaaaatagaaatccattttgatttgcagttcaacatatcacaagtttccattcaagctttaggagaagacaaacagatgttgcctgaccagacgaaaatctcctcagaactttttagtaagtctgataaagaagacagggagagtcccagtggccttgaaagagaaacagagcaggcagaagaatccactaacatggtggagtttatgagtgctgaagatgaccgctgcctaataactctccacttaaatgaccaatctgagccacctgttattggggaacctgcctctgatagtcaccttcagccggtccctccgttcggggtccctgacttcccgcaacaacctaagtctcattacagaaaacatctcttctctgagagtaatcaagattcaagtaccagtgaactatcttggaccagtaaccagaaaaagaaatccctaaaatcatattccagtagaaagaagacaagaaccagaagtaatttgagaatcttgccagttttccctcccagtagtggcagtggccatgagaaagaccaagctaagcttctatcaccatcagagaaagaaatacccgagcaaaataacaccacatctccaaagacttctgaacaaaaattccaagatagttttgcttttttgactgctgaagattctgcccagaaaacagagcttcaagatcctcactcactgagtgagctctcttccttgaagcactcagaagatgaagaaaaacctaagattgtgaaccaagaatcactaacagaaagtactagcttgaaacataagctgagaaacttggaagacaaagacataccagaaggtagttttgctaagtcacaacaatcaagattggaagaagaggttgctncgggatcccctttctcaataacagaagaaagagagttgccagaaggaatttccacttcatccctagaagttgtgccagagaacttgaacggttctgccattctcccaacctttgaaaacttcactaaaaaacggaaaagaaaatatgagcttaggtacagaaagcgtccgtttaattcagaaaatgcaaagaaagcaccggattgcctaataaaacttttaaaccagatgcaactgttcagactcaataaactagagcgctttcaaaatttggttcttcaagagttgagcagtcttaagcaggatattcaggccctggaacaccttgagaaggaggttctggaattctgggggaaacagtctgctgatctgcaatctttctgtgatctgcaagtgctgaggttcaattcaactcagacttcataagaaagccaaagcctggttttatgattgcagccctcagcctgggctgcctgaagacgaagagaaagagcaaggttattgttggctcaggccttgttagccagacttcgtgctctgtacgcattcaatttcctcccctccaaacatcatccctgggaactgctgagttcagatagaatatatgttggtagtttgcagttgggttattatccatttgttcataaaaattaaccttttgtattaaaatttggtcagatagtattaatagaaagttcaggatgttaaacaacttggagtggtgttgcttttttttttataaaagtaaaatggacttttttttgtttgagaaatgtcttcaagttttgtgtgaataaaacactttagcagcatctgtataaatacaattgga

SEQ ID NO: 306378 - DNA, 1837 bp, Homo sapiens
  misc_feature (1006)..(1006): n is a, c, g, or t
agatggcgccactgcactccagcctgggcgatagggtgagactccatctcaaaaaaaagaaaaaagaaaaagaaataactctcctctttggttttggttcttctaaaatgtagagaggcttgtctttgcaaaaaatattcccatacttttcttttgccatctgacttagtattttcaagtagtattaggcacaatattgagattggtctgcttttgaacagtcatccaccatctcttctgttgcaaacgttttattagaaaggattttgtcatcctatacaacagcaacttggttgagaattgactgatggaataatccttttcttccactccatacttctttgcttttatattatataagagagcccagtcttctagaagggtacttctcttatctctagctttgtagaatatgtttagttatacataagaggcactaacacccctctaaaaattctcatttatgatctgtgcttgtagaagtctcattacagaaaacatctcttctctgagagtaatcaagattcaagtaccagtgaactatcttggaccagtaaccagaaaaagaaatccctaaaatcatattccagtagaaagaagacaagaaccagaagtaatttgagaatcttgccagttttccctcccagtagtggcagtggccatgagaaagaccaagctaagcttctatcaccatcagagaaagaaatacccgagcaaaataacaccacatctccaaagacttctgaacaaaaattccaagatagttttgcttttttgactgctgaagattctgcccagaaaacagagcttcaagatcctcactcactgagtgagctctcttccttgaagcactcagaagatgaagaaaaacctaagattgtgaaccaagaatcactaacagaaagtactagcttgaaacataagctgagaaacttggaagacaaagacataccagaaggtagttttgctaagtcacaacaatcaagattggaagaagaggttgctncgggatcccctttctcaataacagaagaaagagagttgccagaaggaatttccacttcatccctagaagttgtgccagagaacttgaacggttctgccattctcccaacctttgaaaacttcactaaaaaacggaaaagaaaatatgagcttaggtacagaaagcgtccgtttaattcagaaaatgcaaagaaagcaccggattgcctaataaaacttttaaaccagatgcaactgttcagactcaataaactagagcgctttcaaaatttggttcttcaagagttgagcagtcttaagcaggatattcaggccctggaacaccttgagaaggaggttctggaattctgggggaaacagtctgctgatctgcaatctttctgtgatctgcaagtgctgaggttcaattcaactcagacttcataagaaagccaaagcctggttttatgattgcagccctcagcctgggctgcctgaagacgaagagaaagagcaaggttattgttggctcaggccttgttagccagacttcgtgctctgtacgcattcaatttcctcccctccaaacatcatccctgggaactgctgagttcagatagaatatatgttggtagtttgcagttgggttattatccatttgttcataaaaattaaccttttgtattaaaatttggtcagatagtattaatagaaagttcaggatgttaaacaacttggagtggtgttgcttttttttttataaaagtaaaatggacttttttttgtttgagaaatgtcttcaagttttgtgtgaataaaacactttagcagcatctgtataaatacaattgga

SEQ ID NO: 306379 - DNA, 805 bp, Homo sapiens
catgacaagaaatgtctggagaagagtctgaagtatccttgtaatcagatgacttattaagaaagtctgctgtcacatccaagcgatcccaatgatatttactgcttttatgtttattagactcaataaactagagcgctttcaaaatttggttcttcaagagttgagcagtcttaagcaggatattcaggccctggaacaccttgagaaggaggttctggtaagttctttctgtgtggaacattttctgacttcggatctttcccagggaaaaataacgctagctacttaaacaaaacttttgttcaatcttaggaattctgggggaaacagtctgctgatctgcaatctttctgtgatctgcaagtgctgaggttcaattcaactcagacttcataagaaagccaaagcctggttttatgattgcagccctcagcctgggctgcctgaagacgaagagaaagagcaaggttattgttggctcaggccttgttagccagacttcgtgctctgtacgcattcaatttcctcccctccaaacatcatccctgggaactgctgagttcagatagaatatatgttggtagtttgcagttgggttattatccatttgttcataaaaattaaccttttgtattaaaatttggtcagatagtattaatagaaagttcaggatgttaaacaacttggagtggtgttgcttttttttttataaaagtaaaatggacttttttttgtttgagaaatgtcttcaagttttgtgtgaataaaacactttagcagcatctgtataaatacaattgga

SEQ ID NO: 306380 - DNA, 2012 bp, Homo sapiens
  misc_feature (2)..(2): n is a, c, g, or t
  misc_feature (17)..(18): n is a, c, g, or t
  misc_feature (1204)..(1204): n is a, c, g, or t
gntttgaaggacagtanncgttttctcaatcacctaaacaacagacttggtgaccaaagaagggtgtattcatttccgtgtattgctgcttttgctgatgagcatgagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagaaacggagaagataaagatatttatcatttacctgaagaagcccatgattatcagctacaaagaagtcatgaaaatagaaatccattttgatttgcagttcaacatatcacaagtttccattcaagctttaggagaagacaaacagatgttgcctgaccagacgaaaatctcctcagaactttttagtaagtctgataaagaagacagggagagtcccagtggccttgaaagagaaacagagcaggcagaagaatccactaacatggtggagtttatgagtgctgaagatgaccgctgcctaataactctccacttaaatgaccaatctgagccacctgttattggggaacctgcctctgatagtcaccttcagccggtccctccgttcggggtccctgacttcccgcaacaacctaagtctcattacagaaaacatctcttctctgagagtaatcaagattcaagtaccagtgaactatcttggaccagtaaccagaaaaagaaatccctaaaatcatattccagtagaaagaagacaagaaccagaagtaatttgagaatcttgccagttttccctcccagtagtggcagtggccatgagaaagaccaagctaagcttctatcaccatcagagaaagaaatacccgagcaaaataacaccacatctccaaagacttctgaacaaaaattccaagatagttttgcttttttgactgctgaagattctgcccagaaaacagagcttcaagatcctcactcactgagtgagctctcttccttgaagcactcagaagatgaagaaaaacctaagattgtgaaccaagaatcactaacagaaagtactagcttgaaacataagctgagaaacttggaagacaaagacataccagaaggtagttttgctaagtcacaacaatcaagattggaagaagaggttgctncgggatcccctttctcaataacagaagaaagagagttgccagaaggaatttccacttcatccctagaagttgtgccagagaacttgaacggttctgccattctcccaacctttgaaaacttcactaaaaaacggaaaagaaaatatgagcttaggtacagaaagcgtccgtttaattcagaaaatgcaaagaaagcaccggattgcctaataaaacttttaaaccagatgcaactgttcagactcaataaactagagcgctttcaaaatttggttcttcaagagttgagcagtcttaagcaggatattcaggccctggaacaccttgagaaggaggttctggtaagttctttctgtgtggaacattttctgacttcggatctttcccagggaaaaataacgctagctacttaaacaaaacttttgttcaatcttaggaattctgggggaaacagtctgctgatctgcaatctttctgtgatctgcaagtgctgaggttcaattcaactcagacttcataagaaagccaaagcctggttttatgattgcagccctcagcacttcaacaaaagtgtcacctttagcagggcagaaatattcatcatgttgttattaattactagatgctctagtgaagtttgagtggatgaaattgcacatacaggtctaaactagcttgaaaagaataggagctggttctacatgagctgtcttacgtacagtgcttcagtctcagagaaatctgcaacatctatcatttgtttctagggccactgccgcctgggcaacaaagtgagactcttgtctca

SEQ ID NO: 306381 - DNA, 2179 bp, Homo sapiens
ctattctatacattgtattttaacaatattttactcatgtatcatctccactatcaaattagtgtataatcatttggtaaattagatcaaaaacatatactggtcattgtttttgaaaaatctaaatttcatcttgatgaagactaaatgtgaaatatcttgggcagtagtagtaggagccatacaccagtgaacaaattatgaaaatctgtgaaaggaagaggaaaaatgttcaaaatttagaagtatatttattttaggattgcttaacctactgtattattcgtaacaaccagagctactaatctgacctgacaactaatatgtttacattagcgccttcttttacaaatttgtgagaagtttcattatgaacactctgctgacaaattgtgaatttaaagccacatgtttctatgttaaaaaggatcaaaatgtttggttataaatcctcaggattaaaagtattagaaataattttacatattcaggcaagaagagaaaagctatttaagatttcccagaaatattttggaaaagagcagcactgggaaatagaaattaatgtaatcagttgcaagatacttgccttctataattataacaacttaatctgttaggcacctttggctattcaataatcattggatgttgtaatagaatgtaagtggcttttaatgtagctccaaggatatttataaattgtgttattgctgttattgttttaaatgtgagtgaatattaaattataggaagtggtatcaagtgataggaaaatggcattaggttttgaaattttattttgataatttaacacatatggagggtttgctatatgtatgagatattctgttagatgctgtgggagctagagagatatactctttttcactcaaagagagtaaaatatagtgggagagaccctaataactattttggtgaaggatgaatctaattccttatctctgacatcgtaagaagtgattagagacctagtttatgcataagcaattccttagtgtccaattaggttttattggcatgaaaaagaaatattaaaaaacctaatatttatagaactccaaatctcctagaattggataatgtattttctagtaagaaaactatagaaattttaaatatatatatttcctgtagtatcaagactctggctgacattgagagaaatatatgtacatgttgtgtttattttcagttttggtgttggattcctggtattgtcacctaagtgctcattttcaggaaaatcagattctacaataaacacttactgcttaaagttcagtaaacttgtgataacctcataacctctgtagtctaaaagttaaggaattataagatgtcacatgtcaagttaacatccagttctacttcttaaccttttttccctttgtaaacagcactttaattagacatgatttaattagataacaattattccatggctggatatgtactggattttcacttacagtacattgatttggtgttgatacacatttgaaaagagtgaggaatacaatacatttttaatacaataggtttacaaattttcctactggtgtgaatatggagtcaaataaaaatccagtttacatctctgcagagagaaaaattgttatccatatgtcttttatattatacatctttactagagataacttattgttaattttgtcaagttatgtgtaagtcccatttatttttaaatactaagcaaaaagttccaagtttgccttaaaatacaagtgaagttaaagaactggatgataatgcctatatttttgccttatgaattgtgctgtgtattataaaccagcaacggttttgattttaacaggattctgaaattttgtagctgtagagtactaatatttgtactctcttgcaaagaatgtgatctagttgtggattatgttagtttaaatgtttttgtatatgtattttacctctgaacatgtacctttttagcatcagggttttattttatttatgtttacacactaaagtgtcatttaactagttaagaattgtattcttttttattttaaaggttatttgtgtgtatcattgtggtaatgttctgtaattattatggttaaatttcatttaatgtaaaatgtttaaaataaaaatgaaaaatctaaaaatgtatatg

SEQ ID NO: 306382 - DNA, 1904 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306383 - DNA, 935 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaa

SEQ ID NO: 306384 - DNA, 787 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgcccctttcctccttccatattttgcatctatctgcgactgggataagttcagcttttgtatggg

SEQ ID NO: 306385 - DNA, 1921 bp, Homo sapiens
  misc_feature (40)..(40): n is a, c, g, or t
gacccacgcgtccgcggacgcgtgggtcgacccacgcgtncgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306386 - DNA, 1815 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306387 - DNA, 1902 bp, Homo sapiens
aggctggtaccggtctgggatgtttgaggatcagctgcggggcagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306388 - DNA, 2167 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaagaaaaaaacagggcgcgccgcaagaagaacctagaggaggcccaagaaacgcgaacccagcgacatggacacacaggggggtcccacaaaggagcgcgcaattatacaagccaagaccacgggccgccgtgcaacaacggcataacctgggaaaacgcgcaagccatgggactcttgcgaagcaacctagccacgaggagtacacaagcgggcaacacacaacgagaataaacgcaaggcaaggacacgcaagcgtcaacgta

SEQ ID NO: 306389 - DNA, 2453 bp, Homo sapiens
taaattctattccaaattacaaagccgggcacggtggctcacgcctgtaaatccagcactttgggaggccgaggtgggcggatcacgaggtcaggagttggagaccagcctgaccaacatggtgaaacccggtctctgctaaaaatacaaaacttagctgggcgtggccacgcctgtaatcccagctactcaggaagctgaggcaagagaatcacttgaacctgggaggcagaggtcgcggtgagccgagatgcgccactgcactccagcctgggtgacagagcaaggctctgtctcagaaaagttaaagaaaaagaaagtctctctgtcacatttctcttcccttagttctctgtctctgcttcttcagtgaagtctgtttcagcctgcttcttccttattcttttgctttaatctatgcctaataggctgcattcacagatccctgctaacttgatcaggtaaccctggactttgcttttaaaaccacactggttctttgttatgggaaacctatgtaatgcggttagggacaatctgatcaaagcatattcttctgtccttaactctacaaggtacatacatagctgcaggatgtcgagaaaaagggacaggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306390 - DNA, 1943 bp, Homo sapiens
  misc_feature (84)..(84): n is a, c, g, or t
gacaaactttcatttcagagcatcactactgtctgtggccctggaaattaaaatggatcacagaagtgaatgggacaaaaggcnagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306391 - DNA, 1938 bp, Homo sapiens
tgatggtttcccaagtttgactctccattgccgattccctgccacattccttcaggaaactgttttgtcttcggtttcctgttaatccctattatataggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306392 - DNA, 1872 bp, Homo sapiens
gtaccatgtatagcggatagggtgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306393 - DNA, 2108 bp, Homo sapiens
tctcttgattaagccccctgtgagtcagagaaactgtttctctgatggtactttggaatcctttgtttaaatgctttctctgtcaattcagtttacttaccctgggtctttctcaatgggaaatatcaaaatctgaccaagttgaggtaagggacttacagaggtacctctgtatccccttgcagccccagtgggactaggggaaggtatctggtttaccagtggtgatgggaggcttcaggactgaaggtatgttcgtatctcttcaggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306394 - DNA, 1933 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaatcagtcgacgcggccgcgaatttagtagt

SEQ ID NO: 306395 - DNA, 1812 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacactgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306396 - DNA, 1807 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306397 - DNA, 1850 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306398 - DNA, 1847 bp, Homo sapiens
  misc_feature (84)..(84): n is a, c, g, or t
gacaaactttcatttcagagcatcactactgtctgtggccctggaaattaaaatggatcacagaagtgaatgggacaaaaggcnagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306399 - DNA, 1777 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccttgacagaattctcccaaaaatgcttaaaacttctggaattagattcgcccactatactgcagtctaggctgagtgggagataacggctctcag

SEQ ID NO: 306400 - DNA, 1706 bp, Homo sapiens
aggaaagaatagatgatagatttgaggacctgctctaccaaatattagtactacggcaagtaaaatttagtgtggcattggtgtggaatagactaaccagtgaaacagactaaagggcttagaatcgtagtcacacatgtttggaaatgcaatataaaacagaagacattgcagataaatggcgaaaggagaatggagagacaagtgaatatccacatgagaaaaatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306401 - DNA, 1835 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcattctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306402 - DNA, 1454 bp, Homo sapiens
acaaatcccacaccacatccacagcctaggtccatcaccattctaggcgactagtcccccttacggagcaggccgcgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306403 - DNA, 1632 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306404 - DNA, 1162 bp, Homo sapiens
  misc_feature (40)..(40): n is a, c, g, or t
gacccacgcgtccgcggacgcgtgggtcgacccacgcgtnctaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306405 - DNA, 1088 bp, Homo sapiens
tcttttggggtctttgctcttttggggtctttgctcttttggggtctttgctctttggggtctttgctcttttggggcctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgccgtgggtctgcagtcgctgcaacctaccctctctctgcctcagccttacacccaagcagtaggtctgtgctctccctgtctctaggtcgctgagagaggtgcttttcttcataaaacctttggggtttggatttccccaggaagatggagaatggaatactcactcttgggtctaatctttccccttgacccagaacttcctccccacaaaaatgcctttaaaaaccttcctgagacttaagcattctgccccacttactaactgccagttctccagcactgaggtggggcagataacggggcatatttaagggggcatctttgtgtaaaagatgcatggagtcaggagaaaaccaccttcataaactgctctgtgcaaagaggaataaaacattttttccaaa

SEQ ID NO: 306406 - DNA, 1332 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagtactatgacgacacctaccccagtgtcaaggagcaaaaggcctttgagaagaacattttcaacaagacccatcggactgacagtgaaattgccctcttggaaggcctgacagtggtatacaaaagcagtatagatctctatttctatgtgattggcagctcctatgaaaatgagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaaaaaaaaaaaaaaaaaaagaaaaaaaaaaagaagaagaaaaaaaaaaataaaaaaaaggaaaaaaaaaaaagggggggggcggacaaataaacctgcccagggccaaagttaacaggaaccacacgaattttgttaaaagggacgaccacaaagaggagattaattacgagagcaagggaccgcttaacaaagtgagctggaaacatgctatcgtattatgagataggcccaccttgggggggcgatctgaaccccccccagtatacggcaggcgacatacagtagggtatgtgtcaaccgcgattgagcggatgtcctgattatgaatcagagcaataattaaaggagaaagactacaagactagaaggaatggtaggtaatgtacaagtacagaca

SEQ ID NO: 306407 - DNA, 1158 bp, Homo sapiens
gcggcgtttcttttgcggctccacgtcggcaccagctgcggggcaagatggaggcgctgattttggaaccttccctgtatactgtcaaagccatcctgattctggacaatgatggagatcgactttttgccaagctgatgcttatggctgttctgaactgtctcttcgactcattgagccagatgctgaggaaaaatgtagaaaagcgagcactgctggagaacatggaggggctgttcttggctgtggatgaaattgtagatggaggggtgatcctagagagtgatccccagcaggtggtacaccgggtggcattaaggggtgaagatgtcccccttacggagcagaccgtgtctcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaaaaaaaaaaaaaaaaaaagaaaaaaaaaaagaagaagaaaaaaaaaaataaaaaaaaggaaaaaaaaaaaagggggggggcggacaaataaacctgcccagggccaaagttaacaggaaccacacgaattttgttaaaagggacgaccacaaagaggagattaattacgagagcaagggaccgcttaacaaagtgagctggaaacatgctatcgtattatgagataggcccaccttgggggggcgatctgaaccccccccagtatacggcaggcgacatacagtagggtatgtgtcaaccgcgattgagcggatgtcctgattatgaatcagagcaataattaaaggagaaagactacaagactagaaggaatggtaggtaatgtacaagtacagaca

SEQ ID NO: 306408 - DNA, 210 bp, Homo sapiens
  misc_feature (14)..(14): n is a, c, g, or t
agagagagagaganagagagagagagagagagagagagagagagagagagagagagagagagaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306409 - DNA, 2619 bp, Homo sapiens
cccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306410 - DNA, 2600 bp, Homo sapiens
cgcggagatgacgcggtgaatgcacgtgtgctggtgctggggtgtcgcaggcgcctgagttaatgcgcaggcagtcccgagtggccagccgtcagccgcccgttcgcgatgggtcaacgacgcgcgccgtcaagaaggtgcagcagagcaggagagcgtaaagaattcttagcctaattgccaacaggacatcattatcttagaacaatggggatagtcccgctcatgaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306411 - DNA, 2323 bp, Homo sapiens
agactgcgtctccgccccgccctctcacccccggattgacactgagcgttctgctggggggcttggcggacccggcacctccgccaatcggcggcctcgcagggcggaccccgggcccagtccagcgtctcggccaatcggacgcgtctgcccgcccagctgcggcctcgcgagcgagtgaatggccgagagtccgcgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306412 - DNA, 1426 bp, Homo sapiens
gagagacgcgggaagcaggggctgggcgggggtcgcggcgccgcagctagcgcaccagcccgagggccgccgccgccgccgcccagcgcgctccggggccgccggccgcagccagcacccgccgcgccgcagctccgggaccggccccggccgccgccgccgcgatgggcaacgccgccgccgccaagaagggcagcgagcaggagagcgtgaaagaattcttagccaaagccaaagaagattttcttaaaaaatgggaaagtcccgctcagctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306413 - DNA, 2460 bp, Homo sapiens
cccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctcccggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306414 - DNA, 3149 bp, Homo sapiens
cccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaacaaaaaaaaaacaagaaaaacaaacaaaaaaaacaaaaaaaaaaacaaacatgcgtgtgtggcgcgcgcgcgcgccgcgcgcgcccccccgagaacgaagttttcttaaacaaccacaccgtggggggggcgcgcgcgcgcgcgcgccccaagtggagtagcagggagcgaacgcggcgcgcgcacaaaaagagggtctcctcacaagagagagaacacactcgggccggagcacaagacaaaaagaggcgggggggggggcgctctctccccccacaaatataaaaagaagcgccgcggggggggggagaacaacaacagagacgtggttcttagtgagaggacaaacacacccgcacaagagagaaggaggtatgcacagagagagagcgtaactcatcagcgaggggggcggccttttatcacaagaagagaggagagagatacaaacaagagagagcagccgcacaaaaatatataaaaataaattatacgcgccccccccagaggagggggggggggggggggga

SEQ ID NO: 306415 - DNA, 1488 bp, Homo sapiens
cccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306416 - DNA, 2246 bp, Homo sapiens
  misc_feature (1926)..(1926): n is a, c, g, or t
  misc_feature (1949)..(1949): n is a, c, g, or t
  misc_feature (1952)..(1952): n is a, c, g, or t
  misc_feature (1962)..(1962): n is a, c, g, or t
  misc_feature (1965)..(1965): n is a, c, g, or t
  misc_feature (1968)..(1968): n is a, c, g, or t
  misc_feature (1981)..(1981): n is a, c, g, or t
cccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgaggtccggatgtggggacacagccctggaagaaacagaccgttccctgctcacccatcctattccctggggagccctgcttgttgtcagaataatctagaagttccttaagtcaggccaggtggtgaagctggacgcgccggccacactgaggccaacacctcaagcccccttgctgtccagccccaaccccgcggttccagaatcccatgggcttccaaaatcccgagcctcacgggaacatcttggccacagaacacaaaccgccctgccagacgaccctccttttcgctcctcatcccagttagtgtgagttttcgcaaattccaaggcagaaaaacgaatgtatttggttcctgttcccaggtgctgtccatagcctcacccaggattgccctcacttagcatttatagcccatgcttcctctcccaaacccagacttgcctaactctgagggttcagatgaggggtggtgaagccatctcagctcacatctatgacaggtgcaaagtgcccaccatccaccaggccccagaatccccatcagtcacaccctgagatagtggcaccctctgtaggagaggtgaggaaacaggctgggaaaagggatgtgtcttggccaagatcacactttggtgagtaggtaatcaccgtaggcaatcattgtaggcactgatggccggagagaggttggggaccccacctctgccctcagctcaaccaccttgctgggaagacccgaccatcccccgacttggtccagcatctcctacacaggagcttttggttggcccggagtcatgacactgtggtgggagcaccctcaggctcagcctgggccccagtcccagctctgccaccgactggctttgaaactttggggctgggtacaatggctcacacctgtaatgccagcaccttgggaagtggaggcttgaggccaggagttccagaccagcctgggcaacatagccagaccccatctctaaaaaaaaaaagactaaggtgggggaatccantgaggccagaagttgagaccagnctnggcaacatancangancccatctaaaacnaaataaaacactcacaccaagggttctggtagtgaaagtgtcggattggggggtaaccccaagggtaagggcccgggggcagttggtgcccagcagcaccatcaggaccctggcatattgctatcccttcgctgtcatatgggggcactggccggcctcacagcaccacctcgagtcgtcaaagagagagaaccagacaaacaacaaaacccccggagaacaaccccgccgcgcagcaacgcaaccgagaccccctcccgcgcgc

SEQ ID NO: 306417 - DNA, 375 bp, Homo sapiens
agcctagaagttcaagaccagcctgggcaacgtagtgagaccctgtctctacaaaaacttcttaaaataactaactcttgaatttttaaagtttttaaagaaatgcagattctcaggccacagtatcagacttcctaaattggaaactgtagggtaggctcaaggagctgttttacaagatgctggcaggcactctgctttggaggcccacacccagtaggaccgttggatggagaaagaagcatcatgggcttcccaagttccagaccagcttcccaccctgtccttgtaccccttcctccaggtgcgcttcccttcccacttcagctctgacttgaaggacctgctgcggaacctcctgcaggtagatctcac

SEQ ID NO: 306418 - DNA, 358 bp, Homo sapiens
gacaactcaaacttatacatggtcatggagtacgtgcccggcggggagatgttctcacacctacggcggatcggaaggttcaggtaagcgggccaccccccatcacatcaggctgtcagggtgtccacaggtggcagtgcacgaccaagccccctgggaatgcagaggagtccagcatacttcaacatgcaggtggtctcccagaccctgtgggtttctgtttcccctctgctgaggaatatgtgatatttcaaccaccacaaaacaaaacagagcaaacagggcaacttaggtgtccaaactgaagttgctgccaggcacggtggttctcaccagtaatcccagcactttgggaggc

SEQ ID NO: 306419 - DNA, 2644 bp, Homo sapiens
gagagacgcgggaagcaggggctgggcgggggtcgcggcgccgcagctagcgcaccagcccgagggccgccgccgccgccgcccagcgcgctccggggccgccggccgcagccagcacccgccgcgccgcagctccgggaccggccccggccgccgccgccgcgatgggcaacgccgccgccgccaagaagggcagcgagcaggagagcgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306420 - DNA, 2714 bp, Homo sapiens
cccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaagtaggagcctccccagccctccccttcccctgaggccggctctgctctcctgctctcgcctcctcctcaccctgtgcccccccatcttgctccagggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306421 - DNA, 2310 bp, Homo sapiens
cccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306422 - DNA, 2512 bp, Homo sapiens
cccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaa

SEQ ID NO: 306423 - DNA, 3178 bp, Homo sapiens
cccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaaggctacaacaaggccgtggactggtgggccctgggggttcttatctatgaaatggccgctggctacccgcccttcttcgcagaccagcccatccagatctatgagaagatcgtctctgggaaggtgcgcttcccttcccacttcagctctgacttgaaggacctgctgcggaacctcctgcaggtagatctcaccaagcgctttgggaacctcaagaatggggtcaacgatatcaagaaccacaagtggtttgccacaactgactggattgccatctaccagaggaaggtggaagctcccttcataccaaagtttaaaggccctggggatacgagtaactttgacgactatgaggaagaagaaatccgggtctccatcaatgagaagtgtggcaaggagttttctgagttttaggggcatgcctgtgcccccatgggttttcttttttcttttttcttttttttggtcgggggggtgggagggttggattgaacagccagagggccccagagttccttgcatctaatttcacccccaccccaccctccagggttagggggagcaggaagcccagataatcagagggacagaaacaccagctgctccccctcatccccttcaccctcctgccccctctcccacttttcccttcctctttccccacagccccccagcccctcagccctcccagcccacttctgcctgttttaaacgagtttctcaactccagtcagaccaggtcttgctggtgtatccagggacagggtatggaaagaggggctcacgcttaactccagcccccacccacacccccatcccacccaaccacaggccccacttgctaagggcaaatgaacgaagcgccaaccttcctttcggagtaatcctgcctgggaaggagagatttttagtgacatgttcagtgggttgcttgctagaatttttttaaaaaaacaacaatttaaaatcttatttaagttccaccagtgcctccctccctccttcctctactcccacccctcccatgtccccccattcctcaaatccattttaaagagaagcagactgactttggaaagggaggcgctggggtttgaacctccccgctgctaatctcccctgggcccctccccggggaatcctctctgccaatcctgcgagggtctaggcccctttaggaagcctccgctctctttttccccaacagacctgtcttcacccttgggctttgaaagccagacaaagcagctgcccctctccctgccaaagaggagtcatcccccaaaaagacagagggggagccccaagcccaagtctttcctcccagcagcgtttccccccaactccttaattttattctccgctagattttaacgtccagccttccctcagctgagtggggagggcatccctgcaaaagggaacagaagaggccaagtccccccaagccacggcccggggttcaaggctagagctgctggggaggggctgcctgttttactcacccaccagcttccgcctcccccatcctgggcgcccctcctccagcttagctgtcagctgtccatcacctctcccccactttctcatttgtgcttttttctctcgtaatagaaaagtggggagccgctggggagccaccccattcatccccgtatttccccctctcataacttctccccatcccaggaggagttctcaggcctggggtggggccccgggtgggtgcgggggcgattcaacctgtgtgctgcgaaggacgagacttcctcttgaacagtgtgctgttgtaaacatatttgaaaactattaccaataaagttttgtttaaaaaaaaaaaaaaaaaaaaaaaaaaaaaaaaaaaaaacaaaaaaaaaacaagaaaaacaaacaaaaaaaacaaaaaaaaaaacaaacatgcgtgtgtggcgcgcgcgcgcgccgcgcgcgcccccccgagaacgaagttttcttaaacaaccacaccgtggggggggcgcgcgcgcgcgcgcgccccaagtggagtagcagggagcgaacgcggcgcgcgcacaaaaagagggtctcctcacaagagagagaacacactcgggccggagcacaagacaaaaagaggcgggggggggggcgctctctccccccacaaatataaaaagaagcgccgcggggggggggagaacaacaacagagacgtggttcttagtgagaggacaaacacacccgcacaagagagaaggaggtatgcacagagagagagcgtaactcatcagcgaggggggcggccttttatcacaagaagagaggagagagatacaaacaagagagagcagccgcacaaaaatatataaaaataaattatacgcgccccccccagaggagggggggggggggggggga

SEQ ID NO: 306424 - DNA, 2341 bp, Homo sapiens
  misc_feature (2021)..(2021): n is a, c, g, or t
  misc_feature (2044)..(2044): n is a, c, g, or t
  misc_feature (2047)..(2047): n is a, c, g, or t
  misc_feature (2057)..(2057): n is a, c, g, or t
  misc_feature (2060)..(2060): n is a, c, g, or t
  misc_feature (2063)..(2063): n is a, c, g, or t
  misc_feature (2076)..(2076): n is a, c, g, or t
cccagtggcctctgggttgggtttctcttcctgctcccaccccacggctccctagctccccctgcaggcagggttctggggacagacagccgaacagacacggcaggtctcatgagccttcccagccaccgtagtgccggtgccctgagaacaggactgagtgatggcttccaactccagcgatgtgaaagaattcttagccaaagccaaagaagattttcttaaaaaatgggaaagtcccgctcagaacacagcccacttggatcagtttgaacgaatcaagaccctcggcacgggctccttcgggcgggtgatgctggtgaaacacaaggagaccgggaaccactatgccatgaagatcctcgacaaacagaaggtggtgaaactgaaacagatcgaacacaccctgaatgaaaagcgcatcctgcaagctgtcaactttccgttcctcgtcaaactcgagttctccttcaaggacaactcaaacttatacatggtcatggagtacgtgcccggcggggagatgttctcacacctacggcggatcggaaggttcagtgagccccatgcccgtttctacgcggcccagatcgtcctgacctttgagtatctgcactcgctggatctcatctacagggacctgaagccggagaatctgctcattgaccagcagggctacattcaggtgacagacttcggtttcgccaagcgcgtgaagggccgcacttggaccttgtgcggcacccctgagtacctggcccctgagattatcctgagcaaagtaggagcctccccagccctccccttcccctgaggccggctctgctctcctgctctcgcctcctcctcaccctgtgcccccccatcttgctccagggctacaacaaggccgtggactggtgggccctgggggttcttatctatgaaatggccgctggctacccgcccttcttcgcagaccagcccatccagatctatgagaagatcgtctctgggaaggtgaggtccggatgtggggacacagccctggaagaaacagaccgttccctgctcacccatcctattccctggggagccctgcttgttgtcagaataatctagaagttccttaagtcaggccaggtggtgaagctggacgcgccggccacactgaggccaacacctcaagcccccttgctgtccagccccaaccccgcggttccagaatcccatgggcttccaaaatcccgagcctcacgggaacatcttggccacagaacacaaaccgccctgccagacgaccctccttttcgctcctcatcccagttagtgtgagttttcgcaaattccaaggcagaaaaacgaatgtatttggttcctgttcccaggtgctgtccatagcctcacccaggattgccctcacttagcatttatagcccatgcttcctctcccaaacccagacttgcctaactctgagggttcagatgaggggtggtgaagccatctcagctcacatctatgacaggtgcaaagtgcccaccatccaccaggccccagaatccccatcagtcacaccctgagatagtggcaccctctgtaggagaggtgaggaaacaggctgggaaaagggatgtgtcttggccaagatcacactttggtgagtaggtaatcaccgtaggcaatcattgtaggcactgatggccggagagaggttggggaccccacctctgccctcagctcaaccaccttgctgggaagacccgaccatcccccgacttggtccagcatctcctacacaggagcttttggttggcccggagtcatgacactgtggtgggagcaccctcaggctcagcctgggccccagtcccagctctgccaccgactggctttgaaactttggggctgggtacaatggctcacacctgtaatgccagcaccttgggaagtggaggcttgaggccaggagttccagaccagcctgggcaacatagccagaccccatctctaaaaaaaaaaagactaaggtgggggaatccantgaggccagaagttgagaccagnctnggcaacatancangancccatctaaaacnaaataaaacactcacaccaagggttctggtagtgaaagtgtcggattggggggtaaccccaagggtaagggcccgggggcagttggtgcccagcagcaccatcaggaccctggcatattgctatcccttcgctgtcatatgggggcactggccggcctcacagcaccacctcgagtcgtcaaagagagagaaccagacaaacaacaaaacccccggagaacaaccccgccgcgcagcaacgcaaccgagaccccctcccgcgcgc

SEQ ID NO: 306425 - DNA, 426 bp, Homo sapiens
ctgtcttttcaatttcagttcagctgccccttcctccagaaagcgctgtctgattcccccttccccagaccacgccaggtactttacatgggcttcttgggggctgcttctccacaaccccaagataccctccaccacggctctgacctctgtgggggtaacccatgtattctttgccctggacttagtgccgtgcaaggacaagcagcccctagcctccctgatgctgtgtcctcagcatcagctaagggcccgacaggccacaggcacacaaatgattctggctgaaggaaccggcctggctccggcatccctagttccaggcattaggggaaatgaggcccctctcacctccccctcctttctgccctcccctccttcccttcccaggtggtgaaactgaaacagatcgaacacaccctgaat

SEQ ID NO: 306426 - DNA, 3026 bp, Homo sapiens
gctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccagaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgtgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcaccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccagatccccttcctcctccactctcacccattatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagac

SEQ ID NO: 306427 - DNA, 2271 bp, Homo sapiens
tagctggtaccgacgctctctctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcaccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccagatccccttcctcctccactctcacccattatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagac

SEQ ID NO: 306428 - DNA, 2670 bp, Homo sapiens
  misc_feature (13)..(13): n is a, c, g, or t
  misc_feature (48)..(48): n is a, c, g, or t
  misc_feature (93)..(93): n is a, c, g, or t
  misc_feature (125)..(125): n is a, c, g, or t
  misc_feature (128)..(128): n is a, c, g, or t
  misc_feature (142)..(142): n is a, c, g, or t
  misc_feature (144)..(144): n is a, c, g, or t
gggagtttaaaanggaatttttattttttagaacaaccctaacatganattttttttttttaaaaaacaatgcttcaattcccaaattaaatnaacagtcaaaataaatggaggagtttcaaganganatcagtcccatttntnttaagtccgggagttgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgtgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcaccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccagatccccttcctcctccactctcacccattatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagac

SEQ ID NO: 306429 - DNA, 2354 bp, Homo sapiens
gctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccagaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgtgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcaccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccaggccggggggacaggcatggctcctcagactgggggggggtaccg

SEQ ID NO: 306430 - DNA, 2027 bp, Homo sapiens
cccacactttctgtggagtagatctgagctagataggagcatcgtgttgttgtgtctgcagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcaccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccagatccccttcctcctccactctcacccattatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagac

SEQ ID NO: 306431 - DNA, 1692 bp, Homo sapiens
  misc_feature (17)..(17): n is a, c, g, or t
tgagctcggtaccggtnagtacggatgtgctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccagatccccttcctcctccactctcacccattatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagac

SEQ ID NO: 306432 - DNA, 1323 bp, Homo sapiens
gctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccagaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgtgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagatgccactgctgcccccacctgaggagtcacccctgtccccaccacctgaggaatcacccacgtccccaccaccttggcatgcaacgtacagagcatcgggctcgtcagtgggggtatcgccaggctctgggggtgaaaatctgctacacaccgggatatgctgctcagcaacggagcaggatagtctgacctcactgggctttgtgaca

SEQ ID NO: 306433 - DNA, 1214 bp, Homo sapiens
gctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccagaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgtgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagatgccactgctgcccccacctgaggagtcacccctgtccccacccccaaatatctcatcaacaacgactaatcaccacccaggcacatgcatgcaccacgg

SEQ ID NO: 306434 - DNA, 1201 bp, Homo sapiens
gctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccagaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgtgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagaatcacttgaacctggaggcagaggttgcagtgagtcgaggttgcgctactgcactccagcctggacaacagagggagactctgtctc

SEQ ID NO: 306435 - DNA, 1061 bp, Homo sapiens
gctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccagaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgtgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaaggtgctaagaccagggccctgcaattgaaccaaaccactaggcactgccattggagccccccttacgag

SEQ ID NO: 306436 - DNA, 954 bp, Homo sapiens
gctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccagaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgtgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagagttttcacccccagagcgtcgggatcctctagaacgccc

SEQ ID NO: 306437 - DNA, 386 bp, Homo sapiens
ctgtggggcgggctcagcagaactgaatcccaactcggagtggtttgagaactactctctctgtcaccgctgtcacaaagcccagggaggtcagactatccgctccgttgctgagcagcataccccggtgtgtagcaggtaagtggtggggactgactgagattgggctggcaggttggaagaactgacattggcaggggccttgttaaattgagtggactttgagaggagagccctaaggtgggcagtgccatccacagcattcgtgcctccccccagtgtgctctctaggatttgttagctggtgagagccacagtgcctgctcccctgtaccctctgcagattttcacccccagagcctggcgatacccccactgacgagccc

SEQ ID NO: 306438 - DNA, 648 bp, Homo sapiens
aaacagcatcccatcagaagtggctaaggacataatgaccattctcaaaagaagatatacaaatggccaaccaacatatgaagagatgctcaacatcactaatgatcagggaaatgccaatccaaaccaccatgagatactaccttactcctgcaagaatggccatcatccaaaaatcaaaaaacagatgttggcatgaatgcggttaacagggaacacttctatgctgctgatgggacgtctttgctcccaaacaccaaccaacaccccttcacaggaccagcactgttaggatggctaagtggatgttttatgttcccacgtccctgactctgtttcagaggttgtgtctgctctcccagcccctgaagccaaaatgacttcctgcagctttcatgagctcagcctcttccctggggtatgtgtgaggggagaagatgcgccatcttgctcccatcaggggttccaattacacttggcacaatcttggctcactgcaacctccacctcccaggttcaagcgattctcccgccccagtctcctgagcagctagtactacaggtgtatgccacccatgcctggcctcttttagctttatatataatatgttatgccattacttttctcttttttttgagacgggtgtt

SEQ ID NO: 306439 - DNA, 2661 bp, Homo sapiens
ccacgaccctgccactgtttttgctgtgttcaccacatctctgatcctgaagtgaattctggaactatggaccacattagactgggcagagattcgcccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttcttttttttttttttttcttttggagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatgggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactctaggggcgcagcaccttttctttgctcccaaacaccaaccaacaccccttcacaggaccagcactgttaggatggctaagtggatgttttatgttcccacgtccctgactctgtttcagaggttgtgtctgctctcccagcccctgaagccaaaatgacttcctgcagctttcatgagctcagcctcttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaagcgattctcctgcctcagcctcccgagtagctggcattacaggcacctgccaccacacccggctaaattttgtatttttagtagagaaggggtttcaccatgttggtgaggcttgtctcaaactgacttcaagtgatccacttgcttcggcctcccaaagtgctgggattacaggcgtgagccatcacgcccagccgagggtatcttttataccaacaaattagatgactgaggtgtaatggacaaatcctatgcacaaagtgagggtatctgaatatgtgggcgggagtcaaaaatttttagctactttaacactaaagtcaaactaaagtagcttcaaaaagacttctcaagatgcagtatggcctgctgaggtttttttgtttttttttttttaagacagagagtcgctcgtcgcccaggccgcagtgcagtagcatgatctcagctcactgcaacctccacctcccgggttcaagcgattctcctgtctcagcctcctaagtagctgggactacaggcacctgccaccacgcccatctaagtttggcatttttagtagcgacggtttcaccttgttggccaggctggttttgttggccaattgtctctaaactgctgtcaaaaaaaggaatggatcagattgtcttgaatagggcagagctaacctgtaatcacctgtgtgatgagaaacagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctcttccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaaacttaaatccgtcgtgcccaaatatagttgtgcttttatttccattag

SEQ ID NO: 306440 - DNA, 2742 bp, Homo sapiens
accaccgggccgggctggggagtctctgaagctggggtccccacctccaggggcttctgctcagaggttaacgtgtgcagtttgaagatgtacatcttgactccggtttaggaggcactttctgcccatcagattccaaactcttaggggcgcagcaccttttctttgctcccatacaccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttcttttttttttttttttcttttggagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatgggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactctaggggcgcagcaccttttctttgctcccaaacaccaaccaacaccccttcacaggaccagcactgttaggatggctaagtggatgttttatgttcccacgtccctgactctgtttcagaggttgtgtctgctctcccagcccctgaagccaaaatgacttcctgcagctttcatgagctcagcctcttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaagcgattctcctgcctcagcctcccgagtagctggcattacaggcacctgccaccacacccggctaaattttgtatttttagtagagaaggggtttcaccatgttggtgaggcttgtctcaaactgacttcaagtgatccacttgcttcggcctcccaaagtgctgggattacaggcgtgagccatcacgcccagccgagggtatcttttataccaacaaattagatgactgaggtgtaatggacaaatcctatgcacaaagtgagggtatctgaatatgtgggcgggagtcaaaaatttttagctactttaacactaaagtcaaactaaagtagcttcaaaaagacttctcaagatgcagtatggcctgctgaggtttttttgtttttttttttttaagacagagagtcgctcgtcgcccaggccgcagtgcagtagcatgatctcagctcactgcaacctccacctcccgggttcaagcgattctcctgtctcagcctcctaagtagctgggactacaggcacctgccaccacgcccatctaagtttggcatttttagtagcgacggtttcaccttgttggccaggctggttttgttggccaattgtctctaaactgctgtcaaaaaaaggaatggatcagattgtcttgaatagggcagagctaacctgtaatcacctgtgtgatgagaaacagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctcttccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaaacttaaatccgtcgtgcccaaatatagttgtgcttttatttccattag

SEQ ID NO: 306441 - DNA, 2815 bp, Homo sapiens
agagctgggagacctgagagtccgcaaaaggttttgtaaggcttgttgagacacagtgcctggtttgagtgggctgatacctacctggcccaatcctggttgtggagccatgttcaaaggttgaccatgctgggccactgacatcatggctggccttggcatcccagactgtagttgctggggctgaggcaatcctccttggctccatgggtatgaacccacctcccatgaccagaggtcccagtgggcatttggagccagggatgggacctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttcttttttttttttttttcttttggagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatgggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactctaggggcgcagcaccttttctttgctcccaaacaccaaccaacaccccttcacaggaccagcactgttaggatggctaagtggatgttttatgttcccacgtccctgactctgtttcagaggttgtgtctgctctcccagcccctgaagccaaaatgacttcctgcagctttcatgagctcagcctcttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaagcgattctcctgcctcagcctcccgagtagctggcattacaggcacctgccaccacacccggctaaattttgtatttttagtagagaaggggtttcaccatgttggtgaggcttgtctcaaactgacttcaagtgatccacttgcttcggcctcccaaagtgctgggattacaggcgtgagccatcacgcccagccgagggtatcttttataccaacaaattagatgactgaggtgtaatggacaaatcctatgcacaaagtgagggtatctgaatatgtgggcgggagtcaaaaatttttagctactttaacactaaagtcaaactaaagtagcttcaaaaagacttctcaagatgcagtatggcctgctgaggtttttttgtttttttttttttaagacagagagtcgctcgtcgcccaggccgcagtgcagtagcatgatctcagctcactgcaacctccacctcccgggttcaagcgattctcctgtctcagcctcctaagtagctgggactacaggcacctgccaccacgcccatctaagtttggcatttttagtagcgacggtttcaccttgttggccaggctggttttgttggccaattgtctctaaactgctgtcaaaaaaaggaatggatcagattgtcttgaatagggcagagctaacctgtaatcacctgtgtgatgagaaacagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctcttccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaaacttaaatccgtcgtgcccaaatatagttgtgcttttatttccattag

SEQ ID NO: 306442 - DNA, 2520 bp, Homo sapiens
ccacgaccctgccactgtttttgctgtgttcaccacatctctgatcctgaagtgaattctggaactatggaccacattagactgggcagagattcgcccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttcttttttttttttttttcttttggagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatgggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactctaggggcgcagcaccttttctttgctcccaaacaccaaccaacaccccttcacaggaccagcactgttaggatggctaagtggatgttttatgttcccacgtccctgactctgtttcagaggttgtgtctgctctcccagcccctgaagccaaaatgacttcctgcagctttcatgagctcagcctcttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaagcgattctcctgcctcagcctcccgagtagctggcattacaggcacctgccaccacacccggctaaattttgtatttttagtagagaaggggtttcaccatgttggtgaggcttgtctcaaactgacttcaagtgatccacttgcttcggcctcccaaagtgctgggattacaggcgtgagccatcacgcccagccgagggtatcttttataccaacaaattagatgactgaggtgtaatggacaaatcctatgcacaaagtgagggtatctgaatatgtgggcgggagtcaaaaatttttagctactttaacactaaagtcaaactaaagtagcttcaaaaagacttctcaagatgcagtatggcctgctgaggtttttttgtttttttttttttaagacagagagtcgctcgtcgcccaggccgcagtgcagtagcatgatctcagctcactgcaacctccacctcccgggttcaagcgattctcctgtctcagcctcctaagtagctgggactacaggcacctgccaccacgcccatctaagtttggcatttttagtagcgacggtttcaccttgttggccaggctggttttgttggccaattgtctctaaactgctgtcaaaaaaaggaatggatcagattgtcttgaatagggcagagctaacctgtaatcacctgtgtgatgagaaacagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctcttccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagc

SEQ ID NO: 306443 - DNA, 1107 bp, Homo sapiens
ctggctccatgatgaccaggcgggtcttgaactcctgagctcaggtgatccacccggctctgcctcccgaagtgctagaccactctcagctcactgcaacctccacctcccgggttcaagcgattctcctgtctcagcctcctaagtagctgggactacaggcacctgccaccacgcccatctaagtttggcatttttagtagcgacggtttcaccttgttggccaggctggttttgttggccaattgtctctaaactgctgtcaaaaaaaggaatggatcagattgtcttgaatagggcagagctaacctgtaatcacctgtgtgatgagaaacagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctcttccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaaacttaaatccgtcgtgcccaaatatagttgtgcttttatttccattag

SEQ ID NO: 306444 - DNA, 1528 bp, Homo sapiens
ccacgaccctgccactgtttttgctgtgttcaccacatctctgatcctgaagtgaattctggaactatggaccacattagactgggcagagattcgcccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttcttttttttttttttttcttttggagatggtctggctctgtcacccaggctggagtgcagtggtgcaatcatagctcaccacagcctcaaactaggggtcacttctaagggatgctgggggttgggcggaaggggtgaggaggtaggattgagtaacttgctgccaccacgcccatctaagtttggcatttttagtagcgacggtttcaccttgttggccaggctggttttgttggccaattgtctctaaactgctgtcaaaaaaaggaatggatcagattgtcttgaatagggcagagctaacctgtaatcacctgtgtgatgagaaacagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctcttccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaaacttaaatccgtcgtgcccaaatatagttgtgcttttatttccattag

SEQ ID NO: 306445 - DNA, 489 bp, Homo sapiens
tcagcatttctttatcgtgaacaccagtttccaaagaaggaggatcgttctgcagtgtcagcattaaaaccttcattggcggatatttatgataaggagccgcccctgtagccaattcaattgctgtaattccaaaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggtaaagccggggatatggtttcatggtcactcctttggatagatgaaaagagcagatattaacgtggaatataacctaatgtaatcaggttaatgtcttggtagattttgaaacaagttagaaattctgtcttcacatttttaagcatgtacaggtaagagaa

SEQ ID NO: 306446 - DNA, 432 bp, Homo sapiens
actagtcacggttggctactaagtccacggtggctactagtccacggttggctactagtccacggttggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccaagcggggactagtgatagtccacggttgggtagtcgttattttctcttttctttttttttttttttttttttttttttttttttttttttttt

SEQ ID NO: 306447 - DNA, 4568 bp, Homo sapiens
agcggggaggaagaggggaaagtttggcccgtgcgtggggctggggtggagggcgggacagaggggctggggtggagggcgggacagaggggctgggcccaggcaaagcttctgtcgctgctgctgcggaggccgaggacaggacgtgggctgggccgggcagtgccggactcggaggagcaggaggcgaggtccgccggagctctgagcccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaggactcgagcgccctgccctggtccatcaacagggacgattacgagctgcaggaggtgatcgggagtggagcaactgctgtagtccaagcagcttattgtgcccctaaaaaggagaaagtggcaatcaaacggataaaccttgagaaatgtcaaactagcatggatgaactcctgaaagaaattcaagccatgagtcaatgccatcatcctaatattgtatcttactacacatcttttgtggtaaaagatgagctgtggcttgtcatgaagctgctaagtggaggttctgttctggatattattaagcacattgtggcaaaaggggaacacaaaagtggagtcctagatgaatctaccattgctacgatactccgagaagtactggaagggctggaatatctgcataaaaatggacagatccacagagatgtgaaagctggaaacattcttcttggagaagatggctcagtacagattgcagactttggggttagtgcttttttagcaactggtggtgatattacccgaaataaagtgagaaagacctttgttggcaccccttgttggatggcacctgaagttatggaacaggtccgtggttatgatttcaaagctgatatttggagttttggaattacagcaattgaattggctacaggggcggctccttatcataaatatccaccaatgaaggttttaatgctgacactgcagaacgatcctccttctttggaaactggtgttcaagataaagaaatgctgaaaaaatatggaaaatcatttagaaaaatgatttcattgtgccttcaaaaagatccagaaaaaagaccaacagcagcagaactattaaggcacaaatttttccagaaagcaaagaataaagaatttcttcaagaaaaaacattgcagagagcaccaaccatttctgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagagatacagcagagggtgtctctcaggaactcatttctgctggcctggtcgacggaagggatttagtaatagtggcagctaatttgcagaaaattgtggaagaacctcagtcaaatcgatctgtcactttcaaactggcatctggtgtcgaaggctcagatattcctgatgatggtaaactgataggatttgcccagctcagcatcagctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtc

SEQ ID NO: 306448 - DNA, 4551 bp, Homo sapiens
agaaaaacaatttttactattggggtcagtgtgcgctgtatattagtacatgctgggttggtcgtaactgagttgcttggcgtcgaatattcttctgtcgctgctgctgcggaggccgaggacaggacgtgggctgggccgggcagtgccggactcggaggagcaggaggcgaggtccgccggagctctgagcccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaggactcgagcgccctgccctggtccatcaacagggacgattacgagctgcaggaggtgatcgggagtggagcaactgctgtagtccaagcagcttattgtgcccctaaaaaggagaaagtggcaatcaaacggataaaccttgagaaatgtcaaactagcatggatgaactcctgaaagaaattcaagccatgagtcaatgccatcatcctaatattgtatcttactacacatcttttgtggtaaaagatgagctgtggcttgtcatgaagctgctaagtggaggttctgttctggatattattaagcacattgtggcaaaaggggaacacaaaagtggagtcctagatgaatctaccattgctacgatactccgagaagtactggaagggctggaatatctgcataaaaatggacagatccacagagatgtgaaagctggaaacattcttcttggagaagatggctcagtacagattgcagactttggggttagtgcttttttagcaactggtggtgatattacccgaaataaagtgagaaagacctttgttggcaccccttgttggatggcacctgaagttatggaacaggtccgtggttatgatttcaaagctgatatttggagttttggaattacagcaattgaattggctacaggggcggctccttatcataaatatccaccaatgaaggttttaatgctgacactgcagaacgatcctccttctttggaaactggtgttcaagataaagaaatgctgaaaaaatatggaaaatcatttagaaaaatgatttcattgtgccttcaaaaagatccagaaaaaagaccaacagcagcagaactattaaggcacaaatttttccagaaagcaaagaataaagaatttcttcaagaaaaaacattgcagagagcaccaaccatttctgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagagatacagcagagggtgtctctcaggaactcatttctgctggcctggtcgacggaagggatttagtaatagtggcagctaatttgcagaaaattgtggaagaacctcagtcaaatcgatctgtcactttcaaactggcatctggtgtcgaaggctcagatattcctgatgatggtaaactgataggatttgcccagctcagcatcagctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtc

SEQ ID NO: 306449 - DNA, 4603 bp, Homo sapiens
agcggggaggaagaggggaaagtttggcccgtgcgtggggctggggtggagggcgggacagaggggctggggtggagggcgggacagaggggctgggcccaggcaaagcttctgtcgctgctgctgcggaggccgaggacaggacgtgggctgggccgggcagtgccggactcggaggagcaggaggcgaggtccgccggagctctgagcccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaggactcgagcgccctgccctggtccatcaacagggacgattacgagctgcaggaggtgatcgggagtggagcaactgctgtagtccaagcagcttattgtgcccctaaaaaggagaaagtggcaatcaaacggataaaccttgagaaatgtcaaactagcatggatgaactcctgaaagaaattcaagccatgagtcaatgccatcatcctaatattgtatcttactacacatcttttgtggtaaaagatgagctgtggcttgtcatgaagctgctaagtggaggttctgttctggatattattaagcacattgtggcaaaaggggaacacaaaagtggagtcctagatgaatctaccattgctacgatactccgagaagtactggaagggctggaatatctgcataaaaatggacagatccacagagatgtgaaagctggaaacattcttcttggagaagatggctcagtacagattgcagactttggggttagtgcttttttagcaactggtggtgatattacccgaaataaagtgagaaagacctttgttggcaccccttgttggatggcacctgaagttatggaacaggtccgtggttatgatttcaaagctgatatttggagttttggaattacagcaattgaattggctacaggggcggctccttatcataaatatccaccaatgaaggttttaatgctgacactgcagaacgatcctccttctttggaaactggtgttcaagataaagaaatgctgaaaaaatatggaaaatcatttagaaaaatgatttcattgtgccttcaaaaagatccagaaaaaagaccaacagcagcagaactattaaggcacaaatttttccagaaagcaaagaataaagaatttcttcaagaaaaaacattgcagagagcaccaaccatttctgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagagatacagcagagggtgtctctcaggaactcatttctgctggcctggtcgacggaagggatttagtaatagtggcagctaatttgcagaaaattgtggaagaacctcagtcaaatcgatctgtcactttcaaactggcatctggtgtcgaaggctcagatattcctgatgatggtaaactgataggatttgcccagctcagcatcagctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtcaaaaaaaaaaacaaaccaaaacaaaaaaaaattgt

SEQ ID NO: 306450 - DNA, 3904 bp, Homo sapiens
ttcaatggtattaaatgcgttcatcacgttgtgcagttgtcaccaccatctgtatccaaactcttcattttaaaactggaactctatacccattaaatagtaattcttgattcccattcttagccccttggcaatcactttttgtctctatgattttgactactctcaatacctcatataagtagaatcacacagtgtttatctttgcatggctagcgtaatgtccccaagtttcatccatgttgtagcatgttgaagaattttcttgctttttaaggctgaataatatccattgcgtgtgtgtgttgagaagctaaccatctacagcagattatttacgtgaaatacacgtaataactctgggttttaaacaactgattcagatatgaacttacagaaaataaaatgtttgtatgttggtcggggggtgcctgtattgaaaaatcttgaccacaatagttaaactttactgagtcatcacaagtttatagtatattgaaaattcttgcaggttttaatgctgacactgcagaacgatcctccttctttggaaactggtgttcaagataaagaaatgaataaagaatttcttcaagaaaaaacattgcagagagcaccaaccatttctgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagagatacagcagagggtgtctctcaggaactcatttctgctggcctggtcgacggaagggatttagtaatagtggcagctaatttgcagaaaattgtggaagaacctcagtcaaatcgatctgtcactttcaaactggcatctggtgtcgaaggctcagatattcctgatgatggtaaactgataggatttgcccagctcagcatcagctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtcaaaaaaaaaaacaaaccaaaacaaaaaaaaattgt

SEQ ID NO: 306451 - DNA, 3300 bp, Homo sapiens
ccttcttggtgccagggccacagatgtcgggaccaaacatgaaggttcatgtcatcttcaactacaagggcaagaacgtgctgatcaacaaggacatccgttgcaaggatgatgagtttacacacctgtacacactgattgtgcggccagacaacacctatgaggtgaagattgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagagatacagcagagggtgtctctcaggaactcatttctgctggcctggtcgacggaagggatttagtaatagtggcagctaatttgcagaaaattgtggaagaacctcagtcaaatcgatctgtcactttcaaactggcatctggtgtcgaaggctcagatattcctgatgatggtaaactgataggatttgcccagctcagcatcagctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtcaaaaaaaaaaacaaaccaaaacaaaaaaaaattgt

SEQ ID NO: 306452 - DNA, 3984 bp, Homo sapiens
agcggggaggaagaggggaaagtttggcccgtgcgtggggctggggtggagggcgggacagaggggctggggtggagggcgggacagaggggctgggcccaggcaaagcttctgtcgctgctgctgcggaggccgaggacaggacgtgggctgggccgggcagtgccggactcggaggagcaggaggcgaggtccgccggagctctgagcccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaggactcgagcgccctgccctggtccatcaacagggacgattacgagctgcaggaggtgatcgggagtggagcaactgctgtagtccaagcagcttattgtgcccctaaaaaggagaaagtggcaatcaaacggataaaccttgagaaatgtcaaactagcatggatgaactcctgaaagaaattcaagccatgagtcaatgccatcatcctaatattgtatcttactacacatcttttgtggtaaaagatgagctgtggcttgtcatgaagctgctaagtggaggttctgttctggatattattaagcacattgtggcaaaaggggaacacaaaagtggagtcctagatgaatctaccattgctacgatactccgagaagtactggaagggctggaatatctgcataaaaatggacagatccacagagatgtgaaagctggaaacattcttcttggagaagatggctcagtacagattgcagactttggggttagtgcttttttagcaactggtggtgatattacccgaaataaagtgagaaagacctttgttggcaccccttgttggatggcacctgaagttatggaacaggtccgtggttatgatttcaaagctgatatttggagttttggaattacagcaattgaattggctacaggggcggctccttatcataaatatccaccaatgaaggttttaatgctgacactgcagaacgatcctccttctttggaaactggtgttcaagataaagaaatgctgaaaaaatatggaaaatcatttagaaaaatgatttcattgtgccttcaaaaagatccagaaaaaagaccaacagcagcagaactattaaggcacaaatttttccagaaagcaaagaataaagaatttcttcaagaaaaaacattgcagagagcaccaaccatttctgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagagatacagcagagggtgtctctcaggaactcatttctgctggcctggtcgacggaagggatttagtaatagtggcagctaatttgcagaaaattgtggaagaacctcagtcaaatcgatctgtcactttcaaactggcatctggtgtcgaaggctcagatattcctgatgatggtaaactgataggatttgcccagctcagcatcagctaaaccacaaccctggaagaggcggcctaaggagattccacacatgctgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtcaaaaaaaaaaacaaaccaaaacaaaaaaaaattgt

SEQ ID NO: 306453 - DNA, 4375 bp, Homo sapiens
agcggggaggaagaggggaaagtttggcccgtgcgtggggctggggtggagggcgggacagaggggctggggtggagggcgggacagaggggctgggcccaggcaaagcttctgtcgctgctgctgcggaggccgaggacaggacgtgggctgggccgggcagtgccggactcggaggagcaggaggcgaggtccgccggagctctgagcccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaggactcgagcgccctgccctggtccatcaacagggacgattacgagctgcaggaggtgatcgggagtggagcaactgctgtagtccaagcagcttattgtgcccctaaaaaggagaaagtggcaatcaaacggataaaccttgagaaatgtcaaactagcatggatgaactcctgaaagaaattcaagccatgagtcaatgccatcatcctaatattgtatcttactacacatcttttgtggtaaaagatgagctgtggcttgtcatgaagctgctaagtggaggttctgttctggatattattaagcacattgtggcaaaaggggaacacaaaagtggagtcctagatgaatctaccattgctacgatactccgagaagtactggaagggctggaatatctgcataaaaatggacagatccacagagatgtgaaagctggaaacattcttcttggagaagatggctcagtacagattgcagactttggggttagtgcttttttagcaactggtggtgatattacccgaaataaagtgagaaagacctttgttggcaccccttgttggatggcacctgaagttatggaacaggtccgtggttatgatttcaaagctgatatttggagttttggaattacagcaattgaattggctacaggggcggctccttatcataaatatccaccaatgaaggttttaatgctgacactgcagaacgatcctccttctttggaaactggtgttcaagataaagaaatgctgaaaaaatatggaaaatcatttagaaaaatgatttcattgtgccttcaaaaagatccagaaaaaagaccaacagcagcagaactattaaggcacaaatttttccagaaagcaaagaataaagaatttcttcaagaaaaaacattgcagagagcaccaaccatttctgaaagagcaaaaaaggttcggagagtaccaggttccagtgggcgtcttcataagacagaggatggaggctgggagtggagtgatgatgaatttgatgaagaaagtgaggaagggaaagcagcaatttcacaactcaggtctccccgagtgaaagaatcaatatcaaattctgagctctttccaacaactgatcctgtgggtactttgctccaagttccagaacagatctctgctcatctacctcagccagctgggcagattgctacacagccaactcaagtctctctcccacccaccgcagagccagcaaaaacagctcaggctttgtcttcaggatcaggttcacaagaaaccaagatcccaatcagtctagtactaagattaaggaattccaaaaaagaactaaatgatattcgatttgaatttactcctgggagagatacagcagagggtgtctctcaggaactcatttctgctggcctggtcgacggaagggatttagtaatagtggcagctaatttgcagaaaattgtggaagaacctcagtcaaatcgatctgtcactttcaaactggcatctggtgtcgaaggctcagatattcctgatgatggtaaactgataggatttgcccagctcagcatcagctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagtgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtcaaaaaaaaaaacaaaccaaaacaaaaaaaaattgt

SEQ ID NO: 306454 - DNA, 412 bp, Homo sapiens
gttttaatgctgacactgcagaacgatcctccttctttggaaactggtgttcaagataaagaaatgctgaaaaaatatggaaaatcatttagaaaaatgatttcattgtgccttcaaaaagatccagaaaaaaggtaaaatatgagaaaaagtctacttttctctctaataaaacattgtgagaagtctaagaatcacatactcatatgtacagaaaattattttcaaaagaactaaatataaactttaaaaaagtatacagagaccattatactggattggaaatgaattgatttctgccttctttgtagtatacagtgtaccctaaatagttcagctttttccttgttaatttcttacaaagttgtacattgtgaattctgtattaataaatgccaagttagtggagaga

SEQ ID NO: 306455 - DNA, 2410 bp, Homo sapiens
  misc_feature (1318)..(1318): n is a, c, g, or t
  misc_feature (1819)..(1819): n is a, c, g, or t
  misc_feature (1887)..(1887): n is a, c, g, or t
  misc_feature (1992)..(1992): n is a, c, g, or t
  misc_feature (2283)..(2283): n is a, c, g, or t
  misc_feature (2340)..(2340): n is a, c, g, or t
acgcgtttccgggatttctctgtaggtgaggcgggaggctggagggagctgagcccccggggagggggcccgattccgcctcgccgcgcctctggctgctgggccgtgggtttttctcttctcctgcgagtaagaaggacgacggcccctaacccctgaattagccttctatttccattagtgacttagaagctacccggcgcctcatctgggctcacctgagctgaggatcaggaaggggagggggcacagtcattgcctcgcgggcgcggcgggaccccagcggacggctttgtgcggactttcggcaccgttatgcccccctagcccgacaccacctggggctggcgcgccacgttactgttcagggccagacgcaccgccctgcctgctccggggagccggacctccgatcccggggatgggggaccccgagacctcagacccaacggaggggactctgatacctcagaccccacgcggggaccccgaggcttcagacccccacagggtgaccccgagatctcagacccccgcaggagtacctccagacctcaaatccccagtaagggaatgaaagagacttcggatccctgaggcagcaaatcactgtaggggcatcccaggactcaggtcaccgcggggtgaacccagacctcacattcaggcaatccccaggacgccgatcggctggcactacccactgtcccggccaccccccctggagctcaaaggcttggccctccaactgctccaccctgccggctcccaggctcaaacctgcagcccgcggatcccctgccccggaagcaaccagattcgcgggaggttacctgactgatccaaggcaggttctcactccgttgcccaggctggaatgcagtggtgtaatcacagctcactgcagcctcaacctactggactcaaaggataagatctgcttttaattaatttttgtatacggtatgggatagggaccaaagttcatttttttgcatgtatacatatccaaatgttccagcatcatttattaaaaagttatttttgtctctactgcatttcctttgtgcttacatcaaaatctgtgttgcatatgtatgtgtttcattttaggcttcctattgtgttccattgagctatttgtctttttgctgccagcaccatgctgttttgattattgtagctatataaataagtgatgaaatcagatagtttatgtcctacaactttatttttcaaggttattttgtatcttctagattcttcagatttccttttaaatcttagagtcgacttctcattttgcacaaaaaaatantgctgggattttgattgagattgtgttgactctacagatgaatttggggagaattgacattttaaccatattgaatcttctgacccattaacatttaggtcttttaaaatttctctggccagacgcagtggctcacgcctgccactttgggaggccaaggcgggccgatcacaaggtcaggagattgagaccatcctggctaacacagtgaaaccccatctctactaaaaatacaaaaaattagccgggcgtggtggcatgcgcctgtagccccagctacttggaaggctgaggcaggagaatggcatgaacccgggagacagagcttgcagtgagcagagatcttgccactgcactccacctggggcaacagagcgagactccatctcaaaaaaaaaaaatataactgttgttagattttaacctaagtatttgtttttttattttgtttttctttttttcttcttttttttttttttttttttttgagacaggatctcnctctgtctcccaggctgaagtgcaatggtgtgatcatggctcatcttgaagcctcgaccctcctgggntcaagctatcctcccacctcaacctcctgagtagctgggactacaagtacacatgaccatgcccaattcattttttaaattctttgtagaggcggagtcccactntgttgcccaggctggtcttgaactcctgggctcaagcaatcctcccacctcagcttcccaaagtgtagggattacaggcatgagccactgtgcaaggtcttgtgttttttgataatatcgtaaatggtgattttttcatttgtttctgattgttgctaatatatggaaatatagttgatatctgcaattgatctcatgtcctgaaaacttgctaaatctgcttaataattttttgtacattcaaaatgatgttctacaggtagtcgtattgtctatgttggaaggaaagcntttcctcattcaatgtcggtcctgtgtttgaagacctgcaaattaactgataacaanaggttaacaggagaaaagacaaggtttagagtaactcactaaatagaaataaaggtttatagatccactt

SEQ ID NO: 306456 - DNA, 1329 bp, Homo sapiens
acgcgtttccgggatttctctgtaggtgaggcgggaggctggagggagctgagcccccggggagggggcccgattccgcctcgccgcgcctctggctgctgggccgtgggtttttctcttctcctgcgagtaagaaggacgacggcccctaacccctgaattagccttctatttccattagtgacttagaagctacccggcgcctcatctgggctcacctgagctgaggatcaggaaggggagggggcacagtcattgcctcgcgggcgcggcgggaccccagcggacggctttgtgcggactttcggcaccgttatgcccccctagcccgacaccacctggggctggcgcgccacgttactgttcagggccagacgcaccgccctgcctgctccggggagccggacctccgatcccggggatgggggaccccgagacctcagacccaacggaggggactctgatacctcagaccccacgcggggaccccgaggcttcagacccccacagggtgaccccgagatctcagacccccgcaggagtacctccagacctcaaatccccagtaagggaatgaaagagacttcggatccctgaggcagcaaatcactgtaggggcatcccaggactcaggtcaccgcggggtgaacccagacctcacattcaggcaatccccaggacgccgatcggctggcactacccactgtcccggccaccccccctggagctcaaaggcttggccctccaactgctccaccctgccggctcccaggctcaaacctgcagcccgcggatcccctgccccggaagcaaccagattcgcgggaggttacctgactgatccaaggtgatacagctggtaactgatggagatgttggtagtgaaattcatgtacttttagttctttctatggaatctagaggtagaatacatgtacaagaatatcgactaccgtctactcaggtctctgttttatctgtttattcattaactctcagcttttaataggatccaatgagccctctgtggttctgaagaattgccttgagtatatgcagcctcaaaaaacccacttcctaggctcagtctttgatcaatatttatcattatcaccagttattgttctaataaactctactctggaaaaaaacatcaaaaaacagaaaaaaaaaaacacaacaaaaaggaacaaacaaaacaaaacacggggggggccgcacggaaaaaaaattccccccggggggcgccccggacaagtagccgcacaccgcgagatagtgtgggcacacaagaaggggcgcccacatagggggggacaccgaaatacg

SEQ ID NO: 306457 - DNA, 2994 bp, Homo sapiens
  misc_feature (1902)..(1902): n is a, c, g, or t
  misc_feature (2403)..(2403): n is a, c, g, or t
  misc_feature (2471)..(2471): n is a, c, g, or t
  misc_feature (2576)..(2576): n is a, c, g, or t
  misc_feature (2867)..(2867): n is a, c, g, or t
  misc_feature (2924)..(2924): n is a, c, g, or t
acgcgtttccgggatttctctgtaggtgaggcgggaggctggagggagctgagcccccggggagggggcccgattccgcctcgccgcgcctctggctgctgggccgtgggtttttctcttctcctgcgagtaagaaggacgacggcccctaacccctgaattagccttctatttccattagtgacttagaagctacccggcgcctcatctgggctcacctgagctgaggatcaggaaggggagggggcacagtcattgcctcgcgggcgcggcgggaccccagcggacggctttgtgcggactttcggcaccgttatgcccccctagcccgacaccacctggggctggcgcgccacgttactgttcagggccagacgcaccgccctgcctgctccggggagccggacctccgatcccggggatgggggaccccgagacctcagacccaacggaggggactctgatacctcagaccccacgcggggaccccgaggcttcagacccccacagggtgaccccgagatctcagacccccgcaggagtacctccagacctcaaatccccagtaagggaatgaaagagacttcggatccctgaggcagcaaatcactgtaggggcatcccaggactcaggtcaccgcggggtgaacccagacctcacattcaggcaatccccaggacgccgatcggctggcactacccactgtcccggccaccccccctggagctcaaaggcttggccctccaactgctccaccctgccggctcccaggctcaaacctgcagcccgcggatcccctgccccggaagcaaccagattcgcgggaggttacctgactgatccaaggtgatacagctggtaactgatggagatgttggtagtgaaattcatgtacttttagttctttctatggaatctagaggtagaatacatgtacaagaatatcgactaccgtctactcaggtctctgttttatctgtttattcattaactctcagcttttaataggatccaatgagccctctgtggttctgaagaattgccttgagtatatgcagcctcaaaaaacccacttcctaggctcagtctttgatcaatatttatcattatcaccagttattgttctaataaactctactctggaaatatggtgttatggtttacttgggagtgtgagttcagggcatcattgaagactcacgtacttttactgagaaagtgacattgatctctgtagatttagaattaaatgatatgatgaagtatataaaccaattacttttggtcaaggtggtaaaaaaagtttagtatttgatagattcttcatctccacgatcacaaatattttctcctaggatttcttctagaaatattactgctttaggttgtatatcaggtctaggttctactttttttttttttttctccaggcaggttctcactccgttgcccaggctggaatgcagtggtgtaatcacagctcactgcagcctcaacctactggactcaaaggataagatctgcttttaattaatttttgtatacggtatgggatagggaccaaagttcatttttttgcatgtatacatatccaaatgttccagcatcatttattaaaaagttatttttgtctctactgcatttcctttgtgcttacatcaaaatctgtgttgcatatgtatgtgtttcattttaggcttcctattgtgttccattgagctatttgtctttttgctgccagcaccatgctgttttgattattgtagctatataaataagtgatgaaatcagatagtttatgtcctacaactttatttttcaaggttattttgtatcttctagattcttcagatttccttttaaatcttagagtcgacttctcattttgcacaaaaaaatantgctgggattttgattgagattgtgttgactctacagatgaatttggggagaattgacattttaaccatattgaatcttctgacccattaacatttaggtcttttaaaatttctctggccagacgcagtggctcacgcctgccactttgggaggccaaggcgggccgatcacaaggtcaggagattgagaccatcctggctaacacagtgaaaccccatctctactaaaaatacaaaaaattagccgggcgtggtggcatgcgcctgtagccccagctacttggaaggctgaggcaggagaatggcatgaacccgggagacagagcttgcagtgagcagagatcttgccactgcactccacctggggcaacagagcgagactccatctcaaaaaaaaaaaatataactgttgttagattttaacctaagtatttgtttttttattttgtttttctttttttcttcttttttttttttttttttttttgagacaggatctcnctctgtctcccaggctgaagtgcaatggtgtgatcatggctcatcttgaagcctcgaccctcctgggntcaagctatcctcccacctcaacctcctgagtagctgggactacaagtacacatgaccatgcccaattcattttttaaattctttgtagaggcggagtcccactntgttgcccaggctggtcttgaactcctgggctcaagcaatcctcccacctcagcttcccaaagtgtagggattacaggcatgagccactgtgcaaggtcttgtgttttttgataatatcgtaaatggtgattttttcatttgtttctgattgttgctaatatatggaaatatagttgatatctgcaattgatctcatgtcctgaaaacttgctaaatctgcttaataattttttgtacattcaaaatgatgttctacaggtagtcgtattgtctatgttggaaggaaagcntttcctcattcaatgtcggtcctgtgtttgaagacctgcaaattaactgataacaanaggttaacaggagaaaagacaaggtttagagtaactcactaaatagaaataaaggtttatagatccactt

SEQ ID NO: 306458 - DNA, 329 bp, Homo sapiens
gggcccccattgcagtccctcatacccctaactgggcatgataccttctggggggctgtggccagacctgggacttgtcttgtaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacaggtccagggcagaggaccaacgttgatccggccgcgaatttagtagtagtagtcg

SEQ ID NO: 306459 - DNA, 3043 bp, Homo sapiens
ggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccacaaaaaaaagcacaacacacaacacacaaacacacacacaaaacacaaacacaaaaggggcggcagc

SEQ ID NO: 306460 - DNA, 2318 bp, Homo sapiens
tttggatactctgagagccacaggtgctgagaacatgctgctgggtggtcaaacagagagtctgtacggttatatgcaccccaggagaggctgaggtgtaaaatgggctcccctggtctccacagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccacaaaaaaaagcacaacacacaacacacaaacacacacacaaaacacaaacacaaaaggggcggcagc

SEQ ID NO: 306461 - DNA, 3880 bp, Homo sapiens
ggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgctgcctgcctgcctgcctgcccatccccacttgaagtgcccttgtgggtgtggggtctgcccgggcccgcctcatgtgtgaacatgtacagtagaggggtctcaggtgggctgggccatcttgcaggtgaagcacctggaagtgagcagtgcttccatggcagaggacctctgccggaagagcgccatcattgagacctacgtcatggacagccggatcggtcagtgtcccctccccggccctcagccctggtccagccttcacctggccctccctctccattctgtgctgcggcttctctcctctcctctcggaactcagcgaagctactgacaagaccatggcctgtggaggggagaacaggaaagcactgtctcttgatctcgcctcctccctcttctctctttctctgtcatctctccactctccattctccattgtgtctctctgtccactttctcctttcctctccctgtgcctcatcttcctctcctctctctctcccttctctcttctccgtttctctttttcaccccactccttcatcttgtctcgctgtctatattgttttccttctctgtatcttcattgcttttgctttctttcaaactttctccttcacagatttttctttattaatcagaatcatactgaccaacatgtgctgaggactttctgtgtgctctgtgcttcacatacagtcatgtgcatctttccagttccacaagttagttatcctcatttctcggggccatagagctagtgagtgacagagctaggttttgtatgtcaaagcctctgtcctacatgacatggcttttcctgctgccttctcccctggtattcgtctccctcttttctcctctggctctgcctggctctcctctggctctgccgagggggtggttttcagcctgggcccttgcagatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccacaaaaaaaagcacaacacacaacacacaaacacacacacaaaacacaaacacaaaaggggcggcagc

SEQ ID NO: 306462 - DNA, 3751 bp, Homo sapiens
ggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcggtcagtgtcccctccccggccctcagccctggtccagccttcacctggccctccctctccattctgtgctgcggcttctctcctctcctctcggaactcagcgaagctactgacaagaccatggcctgtggaggggagaacaggaaagcactgtctcttgatctcgcctcctccctcttctctctttctctgtcatctctccactctccattctccattgtgtctctctgtccactttctcctttcctctccctgtgcctcatcttcctctcctctctctctcccttctctcttctccgtttctctttttcaccccactccttcatcttgtctcgctgtctatattgttttccttctctgtatcttcattgcttttgctttctttcaaactttctccttcacagatttttctttattaatcagaatcatactgaccaacatgtgctgaggactttctgtgtgctctgtgcttcacatacagtcatgtgcatctttccagttccacaagttagttatcctcatttctcggggccatagagctagtgagtgacagagctaggttttgtatgtcaaagcctctgtcctacatgacatggcttttcctgctgccttctcccctggtattcgtctccctcttttctcctctggctctgcctggctctcctctggctctgccgagggggtggttttcagcctgggcccttgcagatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccacaaaaaaaagcacaacacacaacacacaaacacacacacaaaacacaaacacaaaaggggcggcagc

SEQ ID NO: 306463 - DNA, 1456 bp, Homo sapiens
actccctattttgcattttaccagattccactagttaattctccttacatttctacggggccatatagctacgtgagtaacagagctagtttttgtatttcataacttctgacccccttgacatggcttttcctgctgccttctctctttctctgtcatctctccactctccattctccattgtgtctctctgtccactttctcctttcctctccctgtgcctcatcttcctctcctctctctctcccttctctcttctccgtttctctttttcaccccactccttcatcttgtctcgctgtctatattgttttccttctctgtatcttcattgcttttgctttctttcaaactttctccttcacagatttttctttattaatcagaatcatactgaccaacatgtgctgaggactttctgtgtgctctgtgcttcacatacagtcatgtgcatctttccagttccacaagttagttatcctcatttctcggggccatagagctagtgagtgacagagctaggttttgtatgtcaaagcctctgtcctacatgacatggcttttcctgctgccttctcccctggtattcgtctccctcttttctcctctggctctgcctggctctcctctggctctgccgagggggtggttttcagcctgggcccttgcagatgtgtctgtggcagcaggccacacagaccgcagcgggctgggcagcgtcctgagagacctagtgaagccaggcgacgagaaccttcgggagatgaacaagaagctgcagaacatgctggaggagcagctcaccaagaatatgcacttgcacaaggatatggaagttctgtcccaggaaattgtgcggctcagcaaggagtgcgtggggcctcctgacccagacctagagccaggagaaaccagctaaagacctgcaggctgcacccacctcctccccttcctaccccctaggatgctattcccttgggctgtggtggaaaaatgagggctggagccaaaatcaaatagcttgggagactggacattaaaggggctagaggcctgatggttagtgttaatgatcctgtcttagggcagaggccaccagggagtggggatcctgagggaaggggcagggatttctccttcttcttggtcctggctcccaagggcttctgtcttcatctctgcatgagctctccttcccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccacaaaaaaaagcacaacacacaacacacaaacacacacacaaaacacaaacacaaaaggggcggcagc

SEQ ID NO: 306464 - DNA, 2586 bp, Homo sapiens
ggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaaggcccggacacgggagctggagactctccagcagacagtggaagaacttcaagctcaggtacattccatggatggagccaagggctggtttgaacggcgcttgaaggaagccgaggaatccctgcagcagcagcagcaggaacaagaggaagccctcaagcagtgtcgggagcagcacgctgccgagctgaagggcaaggaggaggagctacaggatgtacgggatcagctcgagcaggcccaggaggagcgggactgccacctgaagaccattagcagcctgaagcaggaggtgaaggacacagtggatgggcagaggatcctggagaagaagggcagtgctgcgctcaaggacctcaagcggcagctgcatttggagcggaaacgggcagataagctgcaggagcgactgcaggacatcctcactaacagcaagagccgctcaggccttgaggagctggttctctcagagatgaactcaccaagccggacccagacaggggacagcagtagcatctcctccttcagctaccgggagatcttgcgggaaaaggagagctcggctgttccagccaggtccttatccagcagccctcaagcccagccccctcggccagcagagctgtcagatgaggaagtggctgagctctttcagcggctggcagagacacagcaggagaaatggatgctggaggagaaggtgaagcacctggaagtgagcagtgcttccatggcagaggacctctgccggaagagcgccatcattgagacctacgtcatggacagccggatcgatgtgtctgtggcagcaggccacacagaccgcagcgggctgggcagcgtcctgagagacctagtgaagccagagaccaactcttttttattttattttattttattttttaatttatgtctggagcctggctactctgcatttgggattggggatgctgggtgggtgtgtggtccatgttcagcgttctagcaacacgtgtgtgtgtgtgtgtgtaaaggctatgcagccaaaataccatctggccagacgggcccacccacaaaaaaaagcacaacacacaacacacaaacacacacacaaaacacaaacacaaaaggggcggcagc

SEQ ID NO: 306465 - DNA, 2121 bp, Homo sapiens
ggaggagtttcagcggatgcaggctcagctcctggaactccggacaaacaactaccagctttcagatgaactacgcaagaatggtgttgaactcaccagtcttcgacagaaggtcgcctacttggataaggagttcagcaaagctcagaaggcactgagcaagagcaagaaagctcaggaagtcgaggtattgctgagtgaaaatgagatgctgcaggcaaagctgcacagccaggaggaggacttccgtttgcagaacagcacactaatggccgagttcagcaagctctgcagccagatggaacagctggagcaagagaaccagcaactgaaggagggggctgcaggagcaggggttgcccaagctgggcccctcgtggatggggagctgctgaggctacaggctgaaaacacagccttgcagaagaacgtggcagccctgcaggaacgctatgggaaagaagccgggaagttctcagctgtcagtgagggccagggggatcccccagggggcccggcccccaccgtcctggcccccatgccgttggcagaggtggagctgaaatgggaaatggagaaagaggagaagagattgctctgggaacagctgcaaggcttagagagctcaaagcaggccgaaacatccaggctgcaggaggaacttgctaagctctccgagaaactgaaaaagaaacaagaaagtttttgccgtctgcagacagaaaaggagactctgtttaatgacagcaggaacaagattgaggaattacaacaacggaaggaagctgatcacaaagcccagttggctcgaacccagaagctgcagcaggaacttgaggctgccaatcagagcttggcagagctgagagatcagcggcagggggagcgcctggaacatgcagcagctttgcgggccctacaagatcaggtatccatccagagtgcagatgcacaggaacaagtggaagggcttttggctgagaacaatgccttgaggactagcctggctgccctggagcagatccaaacagcaaagacccaagaactgaatatgctccgggaacagaccactgggctggcagctgagttgcagcagcagcaggctgagtacgaggaccttatgggacagaaagatgacctcaactcccagctccaggagtcattacgggccaatagtcgactgctggaacaacttcaagaaatagggcaggagaaggagcagttgacccaggaattacaggaggctcggaagagtgcggagaagcggaaggccatgctggatgagctagcaatggaaacgctgcaagagaagtcccagcacaaggaagagctgggagcagttcgtctacggcatgagaaggaggtgctgggggtgcgtgcccgctatgagcgtgagctccgagagctgcatgaagacaagaagcgtcaggaggaggagctccgtgggcagatccgggaggagaagaccccattctataccaacacctattctgatccacggtcaccctgaagtctatatcttatcctaccaggcttcggactaatctcccatattgtaacttactactccggaaaaaaagaaccatctggatacataggtatggcctgagctcatgatatcaattggcttcccaaggagacatccgtgtgagcacaccatatatgcacagacaggcacatagaccgtagacaacacgagcatatttcagctccgctaccataatccattgtattcccaaccggcgtcaagcaattagctgacgtcgcaaatccacgggaaacgcacgcacggcaaagagacctgcggcactgaccacgaaaaccaaggacacagacaacataaccaccgacagggggccggaaggggaataggcgataccaaagcataacagagacaacgagccacaccagaacgacaaaacgaggaacgcacacacacaaaagagccgacacaagagcgcggctattccaacgagccaacggacgacaccacgaagacaccaacaccagcggagcaccactaaaacacacacgcacacccacagcatcacagatagcgcgaggccaaccacccaccacaccgcgcaaaaagcaagagacaaactgacggcacgacaaaaa

SEQ ID NO: 306466 - DNA, 1604 bp, Homo sapiens
tacagtatgtgaaatactctcaccagaacaaaggtcccagcgtcaataagtcaaaccgcagactctgacagctgagtgaatagcagaggccagagtccacttgaagtgttcacactctcagaggccaagtttagatcttatctgcctgagattccttttaacactgatttgtcatagcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgttgca

SEQ ID NO: 306467 - DNA, 614 bp, Homo sapiens
cagccaaaattgcagagaaaggagggcatcaagcttaggggaccaatccctgtctttctaccagtccctgataactactcaagctccctttaaagaggctcatattggaatactctgttgacaagtagataccacttcacctctgctagggtgagcgctggtagctcctccctgttaaatgcccatctcaatgcctctgccctaagtgagttgtgcaataaatgagctgtcactctgaacaggtgggaaagaagtgaactgcttgttcacttgctgctgttgccactgctggtacagaaatagaagcacaaaaaaacaaagacaaaaaacctccaagctcccttcagtagttgctacaccttcagattgagacatccttcctcatttacaaacctcagctgtgtctggggcagggccacagtgaaactgccaggagcaaaaaggcttccaagaaaaagtaccacatcgagattggaaactggggacagatcattcctgggatgtgacgggcaccagaatgctccctctccaaaggatctaaggaccaaagctgacagtttctttacttgtgctgaagaatcaggagacaaacttgaatttgtaatattaagaaa

SEQ ID NO: 306468 - DNA, 2123 bp, Homo sapiens
cagccaaaattgcagagaaaggagggcatcaagcttaggggaccaatccctgtctttctaccagtccctgataactactcaagctccctttaaagaggctcatattggaatactctgttgacaagtagataccacttcacctctgctagggtgagcgctggtagctcctccctgttaaatgcccatctcaatgcctctgccctaagtgagttgtgcaataaatgagctgtcactctgaacaggtgggaaagaagtgaactgcttgttcacttgctgctgttgccactgctggtacagaaatagaagcacaaaaaaacaaagacaaaaaacctccaagctcccttcagtagttgctacaccttcagattgagacatccttcctcatttacaaacctcagctgtgtctggggcagggccacagtgaaactgccaggagcaaaaaggcttccaagaaaaagtaccacatcgagattggaaactggggacagatcattcctgggatgtgacgggcaccagaatgctccctctccaaaggatctaaggaccaaagctgacagtttctttacttggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgttgcatgcctgctctaatttcttttgcccatatatgagtatctccagaatgtctacaaatagtttttgtagcaaatgaaaatttcttcaaataagccttttgtttcaaataaaacttgtctcaaaacatgcttct

SEQ ID NO: 306469 - DNA, 1794 bp, Homo sapiens
cagccaaaattgcagagaaaggagggcatcaagcttaggggaccaatccctgtctttctaccagtccctgataactactcaagctccctttaaagaggctcatattggaatactctgttgacaagtagataccacttcacctctgctagggtgagcgctggtagctcctccctgttaaatgcccatctcaatgcctctgccctaagtgagttgtgcaataaatgagctgtcactctgaacaggtgggaaagaagtgaactgcttgttcacttgctgctgttgccactgctggtacagaaatagaagcacaaaaaaacaaagacaaaaaacctccaagctcccttcagtagttgctacaccttcagattgagacatccttcctcatttacaaacctcagctgtgtctggggcagggccacagtgaaactgccaggagcaaaaaggcttccaagaaaaagtaccacatcgagattggaaactggggacagatcattcctgggatgtgacgggcaccagaatgctccctctccaaaggatctaaggaccaaagctgacagtttctttacttggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgttgca

SEQ ID NO: 306470 - DNA, 1937 bp, Homo sapiens
cagccaaaattgcagagaaaggagggcatcaagcttaggggaccaatccctgtctttctaccagtccctgataactactcaagctccctttaaagaggctcatattggaatactctgttgacaagtagataccacttcacctctgctagggtgagcgctggtagctcctccctgttaaatgcccatctcaatgcctctgccctaagtgagttgtgcaataaatgagctgtcactctgaacaggtgggaaagaagtgaactgcttgttcacttgctgctgttgccactgctggtacagaaatagaagcacaaaaaaacaaagacaaaaaacctccaagctcccttcagtagttgctacaccttcagattgagacatccttcctcatttacaaacctcagctgtgtctggggcagggccacagtgaaactgccaggagcaaaaaggcttccaagaaaaagtaccacatcgagattggaaactggggacagatcattcctgggatgtgacgggcaccagaatgctccctctccaaaggatctaaggaccaaagctgacagtttctttacttggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtgcctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgttgca

SEQ ID NO: 306471 - DNA, 1969 bp, Homo sapiens
cagccaaaattgcagagaaaggagggcatcaagcttaggggaccaatccctgtctttctaccagtccctgataactactcaagctccctttaaagaggctcatattggaatactctgttgacaagtagataccacttcacctctgctagggtgagcgctggtagctcctccctgttaaatgcccatctcaatgcctctgccctaagtgagttgtgcaataaatgagctgtcactctgaacaggtgggaaagaagtgaactgcttgttcacttgctgctgttgccactgctggtacagaaatagaagcacaaaaaaacaaagacaaaaaacctccaagctcccttcagtagttgctacaccttcagattgagacatccttcctcatttacaaacctcagctgtgtctggggcagggccacagtgaaactgccaggagcaaaaaggcttccaagaaaaagtaccacatcgagattggaaactggggacagatcattcctgggatgtgacgggcaccagaatgctccctctccaaaggatctaaggaccaaagctgacagtttctttacttggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacacgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagtaagtactatttataaatttcccatagcaataaaagaattgacaacaaaagatccactaatctaaagtttaaacagcacaaaacttcaacgaacttcagagctttatttttattaacatttcacccaattttagagtgatagtattttcaccataaaagtttttattaaattacataaaatttatccctaatcagtattagaggaaaagtaactaagatttcacgtatacttcatttttagaatataagttctacatagctataatcaatgtgattatactagttagaaggcttttggccagaagtgaaagaatataactcaaaataggttgatcccaagagttaaacaatgtcatgtgatattggtctcttttttcttcttagctttgccatcttctatgttagctttatttttcaaagatgatcagcagaagctccaagatttcattttccttacagctagtaatcacaccacaaacaatgcttttacttcccaataaagctagatgactcaatccctaaaaaaaa

SEQ ID NO: 306472 - DNA, 1056 bp, Homo sapiens
cagccaaaattgcagagaaaggagggcatcaagcttaggggaccaatccctgtctttctaccagtccctgataactactcaagctccctttaaagaggctcatattggaatactctgttgacaagtagataccacttcacctctgctagggtgagcgctggtagctcctccctgttaaatgcccatctcaatgcctctgccctaagtgagttgtgcaataaatgagctgtcactctgaacaggtgggaaagaagtgaactgcttgttcacttgctgctgttgccactgctggtacagaaatagaagcacaaaaaaacaaagacaaaaaacctccaagctcccttcagtagttgctacaccttcagattgagacatccttcctcatttacaaacctcagctgtgtctggggcagggccacagtgaaactgccaggagcaaaaaggcttccaagaaaaagtaccacatcgagattggaaactggggacagatcattcctgggatgtgacgggcaccagaatgctccctctccaaaggatctaaggaccaaagctgacagtttctttacttggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccaggtaactttgccaaagtcttcaatgtctttttaaacccttacagtaaaggatttttattaagaaatttgctcacagaaaattcaaacctctgtgctttgattaaaatatgtgacatgta

SEQ ID NO: 306473 - DNA, 362 bp, Homo sapiens
ggacgcgtgggtcgacccacgctgtcgctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 306474 - DNA, 391 bp, Homo sapiens
gcggccgcctactactactactactactgctcgaattcaagcttctaacgatgtacggggacatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 306475 - DNA, 525 bp, Homo sapiens
  misc_feature (432)..(432): n is a, c, g, or t
  misc_feature (434)..(435): n is a, c, g, or t
  misc_feature (441)..(441): n is a, c, g, or t
ggacgcgtgggtcgacccacgctgtcgctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaacaaaaaaaaaaaaaaaacattttggggcggcctgggcccagaaaaagtttttaaaaccttntnnttgggngcggggcccttgggttcggtgcacctgggccacgggggccccaaggagaccggggcggcacggggcggggttccccaaaaaaaa

SEQ ID NO: 306476 - DNA, 389 bp, Homo sapiens
caagtcccagcgaacccgcgtgcaaactgtcccggactctagccgcctcttcagctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 306477 - DNA, 697 bp, Homo sapiens
caagtcccagcgaacccgcgtgcaaactgtcccggactctagccgcctcttcagctcgccatggatcccaactgctcctgcgccgccggtaagaggctggggatgcccagtgtagactgtagcgctagagaagcaatttctgacccctctttctttctctggtcactcaatttcaggacaggagttgctccttcccaaagagttttggggtatctttctctccattctaggttattcggagccccctttttaccgttaaggagatctgagttaatggcttgctcaagttcccaggaatcggttgtggactgaggaactcggccccgggctcttagtacgccgtcccttgttcaggtatccagggacggttctcacctctgtcttttctccttgcaggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 306478 - DNA, 903 bp, Homo sapiens
caagtcccagcgaacccgcgtgcaaactgtcccggactctagccgcctcttcagctcgccatggatcccaactgctcctgcgccgccggtaagaggctggggatgcccagtgtagactgtagcgctagagaagcaatttctgacccctctttctttctctggtcactcaatttcaggacaggagttgctccttcccaaagagttttggggtatctttctctccattctaggttattcggagccccctttttaccgttaaggagatctgagttaatggcttgctcaagttcccaggaatcggttgtggactgaggaactcggccccgggctcttagtacgccgtcccttgttcaggtatccagggacggttctcacctctgtcttttctccttgcaggtgactcctgcacctgcgccggctcctgcaaatgcaaagagtgcaaatgcacctcctgcaagaaaaagtaagtgggatcctctctttcctctaccccttccctgtcctccagcctgtcccctctccaccatcctcaggggaattaaagcagtctggggatgccccattgcgcggaaattgttgcctcctcagtgatccttatcagggagagcaggaatccttattcccggtgtcgctagtactcatctctgccgcctcctgtctgcccccaggctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 306479 - DNA, 494 bp, Homo sapiens
gcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 306480 - DNA, 441 bp, Homo sapiens
caagtcccagcgaacccgcgtgcaaactgtcccggactctagccgcctcttcagctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaatgaaattcatgcaaatatatgtcaagtgccagaactaaaaaaaa

SEQ ID NO: 306481 - DNA, 267 bp, Homo sapiens
acccccgccccccgggaaaaaaaataacttaggctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 306482 - DNA, 334 bp, Homo sapiens
caagtcccagcgaacccgcgtgcaaactgtcccggactctagccgcctcttcagctcgccatggatcccaactgctcctgcgccgccggtgactcctgcacctgcgccggctcctgcaaatgcaaagagtgcaaatgcacctcctgcaagaaaacaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 306483 - DNA, 308 bp, Homo sapiens
caagtcccagcgaacccgcgtgcaaactgtcccggactctagccgcctcttcagctcgccatggatcccaactgctcctgcgccgccggtgactcctgcacctgcgccggctcctgcaaatgcaaagacaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 306484 - DNA, 164 bp, Homo sapiens
ctgccttccaacgccatggggagcaatctcagccccgctcccagatgtaaagaacgcgacttccacaaacctggattttttatgtacaaccctgaccgtgaccgtttgctatattcctttttctatgaaataatgtgaatgataataaaacagctttgacttga

SEQ ID NO: 306485 - DNA, 604 bp, Homo sapiens
  misc_feature (439)..(439): n is a, c, g, or t
ggacgcgtgggtcgacccacgctgtcgctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaaaaaaaaaaaaaaaaaaaaaaaaaaaaaaaaaaaaaaaaaaaaaaaaaaaaacaaaaaaaaaacaaaanaaaaccgaacagacagagaaaattagggagaagggggggaaaacgacgagaagagcaagacagacgacacggagacacagcggtcccccacagcgcagctgatgcagacaaaggggggagacaaccggcgcggcaccaaggaggggccggatacaacacaagacg

SEQ ID NO: 306486 - DNA, 633 bp, Homo sapiens
  misc_feature (468)..(468): n is a, c, g, or t
gcggccgcctactactactactactactgctcgaattcaagcttctaacgatgtacggggacatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaaaaaaaaaaaaaaaaaaaaaaaaaaaaaaaaaaaaaaaaaaaaaaaaaaaaacaaaaaaaaaacaaaanaaaaccgaacagacagagaaaattagggagaagggggggaaaacgacgagaagagcaagacagacgacacggagacacagcggtcccccacagcgcagctgatgcagacaaaggggggagacaaccggcgcggcaccaaggaggggccggatacaacacaagacg

SEQ ID NO: 306487 - DNA, 1231 bp, Homo sapiens
ggacgcgtgggtcgacccacgctgtcgctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaaaaaaaaaaaaaaaaaaaaaaacaaacaaacaaaaaaactaaaaacacacacacacaaaacaacaaaacaaacacacaacaacacacacacaacacaaacaaaaacaaaacacacagaacgggggggcgcgcacgccacgaataatattctctcacaagagggagagcacgacaccaagcagaaacccacaccacctatacttgttataaaaagaagaaggggcagcccaaaataataaaataagagtactatatatattaagaaagacaaacaacactagcaccagccgatatataaacaaacaaaaaaagacaggaaaacagatgagacgcaaaacgacaatagacgatacgaacagagcaatcgacgactactgtagtcgataaatcacaaggacagcagacaacaaatcacatcatatctactcctcgacgggagagacgcgcacgaacatcaataaaagccgcgactgcagccacccacaaaacaatacaacccatctatcagaaactataattagtatatctaaactaacggaacccagaacaggcggggaggataagatactgatctaacaaacaaaacgaaactactacctgacaagaacagaacagaaaagtacagcagcgcagtgtgagggctgaagaaatgtaagatacgagtaaaaaaaggaacaaatgcgccccgaaggacagacgagacgcaggaacggacagtatataagaagcgcagcaagacccgacccgttggactcagctgcgagacacgaataagacagaggagacaatagagcgagcaaacgtgatccatgctatgattaaaacatcaacaccacttcataatactaaattccaatcccc

SEQ ID NO: 306488 - DNA, 1126 bp, Homo sapiens
ggacgcgtgggtcgacccacgctgtcgctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaggagcggggcgcggccgccacaataataattctctctcctcgagtgaggcgcgcccctcactacgccagccgcaccccgtttgtttattctatcaacaagaggaggcggccgccccacatatatagagaggggtggtggtttatatattagaaaagcaggaagagcgtagcggcgggtataatataaaaaacagtacgcggcgaggtgagagaacagaactcgtgtagcctgcgtgtgcgagtaatctctctgtgtgagtgagagaaccaactctctccttatcttcttcttacgtgggggagggagcgagaccaaccatagtgtgggggagcgacaacactatctctctatctcactcagtagctatatatatatagtcgctctcgctcccataagcgagcgctaagttatatataataaataatattatagagagagagtgatgttagttgacagagcggcgtgtgatgaatacaccaaacatcaactgcacgatcagtatgtaatagtgtagtcggggggatcgagatgaatgagaaaagagatatgtatttgtgctgtgtcagctcgagcgcgagctgatgttaatttatgtttagtttacgtaagaaaattaatatttttatattacacagcgacgggagggagtatgtgttatgatta

SEQ ID NO: 306489 - DNA, 1010 bp, Homo sapiens
ggacgcgtgggtcgacccacgctgtcgctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaaaaaaaaaaaaaaaaaaaaaacttttgtgggccggctgggggccctgggaaaaggttctttaagcccaatgtgcgttgtggtgcaccgcgcgggtcccaccagaattgagcgatcaagtgtgacacaccggtggggcaatagcgcgatgatcaccactagaggaacaactcgggggcaaaggagacacaaaaggtgacttggggaatcttccacaccacaataaaaaaaagcgcgcccgggggggaaaaccacggagagggttgtgtcgaaacaaaattcccaaaatggggaactactgggaggagacaacaaacggggaggttctatacaaccacaagggggagtccgcaaaaggaagggagacagcggaatatatacaaaatatttagccccccagagcagtggtgtgaagaaaacaaacagaactgaccaaaacgcacagagacaaacgaagcagagacgagaaggcaggaaaaagcaaaacacagaaaaagaagcaaaggaaagaaaaacaaggcaacgagacgacgacataagaagagagaacaaacgaacagagagaacaacaaagcacaagctcgaacacaaaaaaaaaaccaacacagaacaagcaaaagaaaacaggacaaacgaagcagg

SEQ ID NO: 306490 - DNA, 1255 bp, Homo sapiens
caagtcccagcgaacccgcgtgcaaactgtcccggactctagccgcctcttcagctcgccatggatcccaactgctcctgcgccgccggtaagaggctggggatgcccagtgtagactgtagcgctagagaagcaatttctgacccctctttctttctctggtcactcaatttcaggacaggagttgctccttcccaaagagttttggggtatctttctctccattctaggttattcggagccccctttttaccgttaaggagatctgagttaatggcttgctcaagttcccaggaatcggttgtggactgaggaactcggccccgggctcttagtacgccgtcccttgttcaggtatccagggacggttctcacctctgtcttttctccttgcaggtgactcctgcacctgcgccggctcctgcaaatgcaaagagtgcaaatgcacctcctgcaagaaaaagtaagtgggatcctctctttcctctaccccttccctgtcctccagcctgtcccctctccaccatcctcaggggaattaaagcagtctggggatgccccattgcgcggaaattgttgcctcctcagtgatccttatcagggagagcaggaatccttattcccggtgtcgctagtactcatctctgccgcctcctgtctgcccccaggctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaaaaaaaaaaaaaaaaaaaaaaaaaaaaaaaaaaaaaaaaaaaaaaaactaaaggggagacccgagaaccaaatcgagcctataaggagtcctataacaatccattggccatttatttacaccttcttaactgggaaaaccattgctaacccatgtaaatcgccatgcaacccatccccctttcgctcagttggaataatagttgaagaggcctgaaccgaacgcccttacaaacagtttctccaccttaatgccgattggaaaattttaggcgtaattttgcggtaaaattcgcgtaaaatttccgttaaatcagctgattttttacacaatttggccacaattggca

SEQ ID NO: 306491 - DNA, 747 bp, Homo sapiens
gagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306492 - DNA, 4211 bp, Homo sapiens
gagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgagacacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgtggagctggagctggagaaggcagcatactgaccagtggctttttgattgattgtttgttatgaggtggagttttactcttgttgtctaggctggagtgccgtggtgcgatcttagctcactgcaacccccgcctcccgggttcaagcgattctcctgcctcagcctcccaagtagctgggattacaggcacgcgccaccacgcctggctaattttgtgtttttggtagagatgggatttcaccatgttggccaggctaatctcgaactcatgatctcgggtgatccgcccaccttggcctcccaaagtgctgggattacagccgtgagccactactcccagcctctgaccagtgttcttaacctggtccgtggacctccagagagtccatgtacctcctagagttacttctaaaagctctgtgagcatgtgtgtgtgtgtgtgtgtgtgtgtatttttttcctggagagagggttcccagaaccaccctcagacacagacaaaggggtcaataacccactaaggattaagaatcattattctagtccaagcattcatgtgtcaggctgcaaaaaacaatacccagggtcacacagagccaagactcaattcaggaccgtggattcccctggtctagaaattttctgctgtgccagcccacaccaccccactgtccttacctcgagtgaatattacatttgagtcatttgctgggcccaaacctagtttccttggtataattttaggataattgtttaagtggcaactattcattcagtaagtagtaagtacttattgtttgcttgtttcattatgaaagagtggcacatgctcattaaagatttggaaaaatgaaagtcaaaacaacaaaatcaccccgagtcccaaccttctgtaacataaccactcttggcattggcgtgttcctttctagtctctctgtagacggggtgtgtgagtgtgtgggtttaactttggttgtcctcatgctgcgtattcagttttgtattctggtcctttgttcatttaacatcttacaagtatttgtccatgttgtaacagtagtgtattagcttacactccttgcctgttcaaaatgtctttcaggcacagcactggcctttaagcctgtgtcgtagggatttccagagaatgctctgtgtattgaagcacagaaggtgtttctgtgtctcagtgtgtttctgtccctaggtttaaggcttcatgtcatggaggagattttatagatgtcaagctaatgaccttagagttttaaaaaatccgtgaccgtggccaggcgcagtggctcacgcctgtaatcccagcactgtgaggctgagatgggcgcatcgcatgaggtcgggagtttgagaccagcctggccaacatggcgaaaccccgtctctactcaaaatacaaaaattagccgggcatgatggcacgtgcctgtaatcccagctactcgggaggctgaggcaggagactcgcttgaacctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccggaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306493 - DNA, 4176 bp, Homo sapiens
gagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgagacacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgtggagctggagctggagaaggcagcatactgaccagtggctttttgattgattgtttgttatgaggtggagttttactcttgttgtctaggctggagtgccgtggtgcgatcttagctcactgcaacccccgcctcccgggttcaagcgattctcctgcctcagcctcccaagtagctgggattacaggcacgcgccaccacgcctggctaattttgtgtttttggtagagatgggatttcaccatgttggccaggctaatctcgaactcatgatctcgggtgatccgcccaccttggcctcccaaagtgctgggattacagccgtgagccactactcccagcctctgaccagtgttcttaacctggtccgtggacctccagagagtccatgtacctcctagagttacttctaaaagctctgtgagcatgtgtgtgtgtgtgtgtgtgtgtgtatttttttcctggagagagggttcccagaaccaccctcagacacagacaaaggggtcaataacccactaaggattaagaatcattattctagtccaagcattcatgtgtcaggctgcaaaaaacaatacccagggtcacacagagccaagactcaattcaggaccgtggattcccctggtctagaaattttctgctgtgccagcccacaccaccccactgtccttacctcgagtgaatattacatttgagtcatttgctgggcccaaacctagtttccttggtataattttaggataattgtttaagtggcaactattcattcagtaagtagtaagtacttattgtttgcttgtttcattatgaaagagtggcacatgctcattaaagatttggaaaaatgaaagtcaaaacaacaaaatcaccccgagtcccaaccttctgtaacataaccactcttggcattggcgtgttcctttctagtctctctgtagacggggtgtgtgagtgtgtgggtttaactttggttgtcctcatgctgcgtattcagttttgtattctggtcctttgttcatttaacatcttacaagtatttgtccatgttgtaacagtagtgtattagcttacactccttgcctgttcaaaatgtctttcaggcacagcactggcctttaagcctgtgtcgtagggatttccagagaatgctctgtgtattgaagcacagaaggtgtttctgtgtctcagtgtgtttctgtccctaggtttaaggcttcatgtcatggaggagattttatagatgtcaagctaatgaccttagagttttaaaaaatccgtgaccgtggccaggcgcagtggctcacgcctgtaatcccagcactgtgaggctgagatgggcgcatcgcatgaggtcgggagtttgagaccagcctggccaacatggcgaaaccccgtctctactcaaaatacaaaaattagccgggcatgatggcacgtgcctgtaatcccagctactcgggaggctgaggcaggagactcgcttgaacctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgtttcatagcatatacctctggtacaggtgggcaagtttttctttgaagaaatgggttattgactcatatgtcataaccttgagtgttactctcccggtgtccggaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306494 - DNA, 2774 bp, Homo sapiens
gagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgagacacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgtggagctggagctggagaaggcagcatactgaccagtggctttttgattgattgtttgttatgaggtgaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccggaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306495 - DNA, 2800 bp, Homo sapiens
gagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgagacacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgtggagctggagctggagaaggcagcatactgaccagtggctttttgattgattgtttgttatgaggtggagttttactcttgttgtctaggctgaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccggaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306496 - DNA, 2829 bp, Homo sapiens
gagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgagacacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgtggagctggagctggagaaggcagcatactgaccagtggctttttgattgattgtttgttatgaggtggagttttactcttgttgtctaggctgcaggagactcgcttgaacctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccggaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306497 - DNA, 2421 bp, Homo sapiens
gagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgagacacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggcaggagactcgcttgaacctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccggaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306498 - DNA, 4145 bp, Homo sapiens
gagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgagacacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgtggagctggagctggagaaggcagcatactgaccagtggctttttgattgattgtttgttatgaggtggagttttactcttgttgtctaggctggagtgccgtggtgcgatcttagctcactgcaacccccgcctcccgggttcaagcgattctcctgcctcagcctcccaagtagctgggattacaggcacgcgccaccacgcctggctaattttgtgtttttggtagagatgggatttcaccatgttggccaggctaatctcgaactcatgatctcgggtgatccgcccaccttggcctcccaaagtgctgggattacagccgtgagccactactcccagcctctgaccagtgttcttaacctggtccgtggacctccagagagtccatgtacctcctagagttacttctaaaagctctgtgagcatgtgtgtgtgtgtgtgtgtgtgtgtatttttttcctggagagagggttcccagaaccaccctcagacacagacaaaggggtcaataacccactaaggattaagaatcattattctagtccaagcattcatgtgtcaggctgcaaaaaacaatacccagggtcacacagagccaagactcaattcaggaccgtggattcccctggtctagaaattttctgctgtgccagcccacaccaccccactgtccttacctcgagtgaatattacatttgagtcatttgctgggcccaaacctagtttccttggtataattttaggataattgtttaagtggcaactattcattcagtaagtagtaagtacttattgtttgcttgtttcattatgaaagagtggcacatgctcattaaagatttggaaaaatgaaagtcaaaacaacaaaatcaccccgagtcccaaccttctgtaacataaccactcttggcattggcgtgttcctttctagtctctctgtagacggggtgtgtgagtgtgtgggtttaactttggttgtcctcatgctgcgtattcagttttgtattctggtcctttgttcatttaacatcttacaagtatttgtccatgttgtaacagtagtgtattagcttacactccttgcctgttcaaaatgtctttcaggcacagcactggcctttaagcctgtgtcgtagggatttccagagaatgctctgtgtattgaagcacagaaggtgtttctgtgtctcagtgtgtttctgtccctaggtttaaggcttcatgtcatggaggagattttatagatgtcaagctaatgaccttagagttttaaaaaatccgtgaccgtggccaggcgcagtggctcacgcctgtaatcccagcactgtgaggctgagatgggcgcatcgcatgaggtcgggagtttgagaccagcctggccaacatggcgaaaccccgtctctactcaaaatacaaaaattagccgggcatgatggcacgtgcctgtaatcccagctactcgggaggctgaggcaggagactcgcttgaacctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccggaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatggtcgccaatccggtaactctaggtca

SEQ ID NO: 306499 - DNA, 2229 bp, Homo sapiens
tgaggccgctggttagttcttattagaagacgtcccccagtaatcagaacctgtggtgtctgcatgtgtgtgtgtgtatttttttcctggagagagggttcccagaaccaccctcagacacagacaaaggggtcaataacccactaaggattaagaatcattattctagtccaagcattcatgtgtcaggctgcaaaaaacaatacccagggtcacacagagccaagactcaattcaggaccgtggattcccctggtctagaaattttctgctgtgccagcccacaccaccccactgtccttacctcgagtgaatattacatttgagtcatttgctgggcccaaacctagtttccttggtataattttaggataattgtttaagtggcaactattcattcagtaagtagtaagtacttattgtttgcttgtttcattatgaaagagtggcacatgctcattaaagatttggaaaaatgaaagtcaaaacaacaaaatcaccccgagtcccaaccttctgtaacataaccactcttggcattggcgtgttcctttctagtctctctgtagacggggtgtgtgagtgtgtgggtttaactttggttgtcctcatgctgcgtattcagttttgtattctggtcctttgttcatttaacatcttacaagtatttgtccatgttgtaacagtagtgtattagcttacactccttgcctgttcaaaatgtctttcaggcacagcactggcctttaagcctgtgtcgtagggatttccagagaatgctctgtgtattgaagcacagaaggtgtttctgtgtctcagtgtgtttctgtccctaggtttaaggcttcatgtcatggaggagattttatagatgtcaagctaatgaccttagagttttaaaaaatccgtgaccgtggccaggcgcagtggctcacgcctgtaatcccagcactgtgaggctgagatgggcgcatcgcatgaggtcgggagtttgagaccagcctggccaacatggcgaaaccccgtctctactcaaaatacaaaaattagccgggcatgatggcacgtgcctgtaatcccagctactcgggaggctgaggcaggagactcgcttgaacctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccggaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306500 - DNA, 1884 bp, Homo sapiens
cgaggggagaacaactacgtctaggacgaaggctggggttaatcggccgagattcagtaagtagtaagtacttattgtttgcttgtttcattatgaaagagtggcacatgctcattaaagatttggaaaaatgaaagtcaaaacaacaaaatcaccccgagtcccaaccttctgtaacataaccactcttggcattggcgtgttcctttctagtctctctgtagacggggtgtgtgagtgtgtgggtttaactttggttgtcctcatgctgcgtattcagttttgtattctggtcctttgttcatttaacatcttacaagtatttgtccatgttgtaacagtagtgtattagcttacactccttgcctgttcaaaatgtctttcaggcacagcactggcctttaagcctgtgtcgtagggatttccagagaatgctctgtgtattgaagcacagaaggtgtttctgtgtctcagtgtgtttctgtccctaggtttaaggcttcatgtcatggaggagattttatagatgtcaagctaatgaccttagagttttaaaaaatccgtgaccgtggccaggcgcagtggctcacgcctgtaatcccagcactgtgaggctgagatgggcgcatcgcatgaggtcgggagtttgagaccagcctggccaacatggcgaaaccccgtctctactcaaaatacaaaaattagccgggcatgatggcacgtgcctgtaatcccagctactcgggaggctgaggcaggagactcgcttgaacctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccggaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306501 - DNA, 1909 bp, Homo sapiens
ggcacatgctcattaagtacttactacttactgaatgaataggttgccactctttcataatgaaacaagcaaacaaattcagtaagtagtaagtacttattgtttgcttgtttcattatgaaagagtggcacatgctcattaaagatttggaaaaatgaaagtcaaaacaacaaaatcaccccgagtcccaaccttctgtaacataaccactcttggcattggcgtgttcctttctagtctctctgtagacggggtgtgtgagtgtgtgggtttaactttggttgtcctcatgctgcgtattcagttttgtattctggtcctttgttcatttaacatcttacaagtatttgtccatgttgtaacagtagtgtattagcttacactccttgcctgttcaaaatgtctttcaggcacagcactggcctttaagcctgtgtcgtagggatttccagagaatgctctgtgtattgaagcacagaaggtgtttctgtgtctcagtgtgtttctgtccctaggtttaaggcttcatgtcatggaggagattttatagatgtcaagctaatgaccttagagttttaaaaaatccgtgaccgtggccaggcgcagtggctcacgcctgtaatcccagcactgtgaggctgagatgggcgcatcgcatgaggtcgggagtttgagaccagcctggccaacatggcgaaaccccgtctctactcaaaatacaaaaattagccgggcatgatggcacgtgcctgtaatcccagctactcgggaggctgaggcaggagactcgcttgaacctgggaggtggaggttgcagtgagccgagaatgccactgcactacagcctgggcgacaaagtgggactgtctcaaaaaaaaaaaaaaaaaaaaaaaaaaaggaacccatgagcaggccagctttcagtctggagccgagtgccttctgtgcatttggatgtttccatttccttccctgagaagattttcttaggctacctagtgagagaacattgaaaatatttttaaaggacatctaagcattgttttggtcatgcatatgctttataattgtgtgttgtttcatagcatatacctctggtacaggtgggcaagtttttctttgaagaaatgggttattgactcatatgtcataaccttgagtgttactctcccggtgtccggaggtcacattcatgttgcggggttggtatgaaattaaatcttggtgatgtgaccctacattctcttctggtccctagaatcggcttctggtctcctgataactgaagtggagacagaagttgagcctgttgcccaggcaaactaaagctgcttttgttcttcggaatctgctttgcctccgtcagcctgcttccttccccacacatgctggccgcactgtccccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306502 - DNA, 918 bp, Homo sapiens
  misc_feature (5)..(5): n is a, c, g, or t
ttgtntttgatcgactaagtggtctgtcgaacatatccctcgtagctctgcatagcatgatggcgctacctcatgctttctggagtacaatggtgttactcgactacatgatgtcgtatatttgactagtgactgtcccggctgttcgcaggttcgttactgtgagcggtgttggcttgaggatctagctaggggatctgacctcttatgattgctgctggactgtaatctccgtagcaaatcgtacctatggatcactctagaatgactcgtaaggtggagtactagaaagtttggagccgtggtgtcctgtgttaactataagctgcattatgctttcgctcggaagacgaggtttggctcacgtgagtactgacttcactgacccctattatgctggggcagcttggttaccactccagacctctgctgtgtgtcctgggcagggccgcgttttggcagtaccctttcaactcatcctaagcttcgtgtagattactttagtatatattttttataaaacataaagcctttcctctcgatggaaatcaaagcttaccatgtgagcactcgaacttctaagttgtgacaggaataacaaaactgcaaggagtggaaaagatggaaaagcctgtgggaaatccgaggccttttgaaagaagggagctgatgacttcacgaccagctcctggagcccctcctttctgctgaagccgcggcatttccctccgtggccacacgagggcacccttggcccttttatcaaagcgccttcacttccccgtgggaatggagacaagtctgtccacggtgttttcttgaaatacccagttgctacccagatttgtatttttatgtaaacaaatacattttcacagaaataaaatttgaaaaataaaagtagaaagagaaaaaaaa

SEQ ID NO: 306503 - DNA, 2070 bp, Homo sapiens
gagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgagacacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgtggagctggagctggagaaggcagcatactgaccagtggctttttgattgattgtttgttatgaggtggagttttactcttgttgtctaggctggagtgccgtggtgcgatcttagctcactgcaacccccgcctcccgggttcaagcgattctcctgcctcagcctcccaagtagctgggattacaggcacgcgccaccacgcctggctaattttgtgtttttggtagagatgggatttcaccatgttggccaggctaatctcgaactcatgatctcgggtgatccgcccaccttggcctcccaaagtgctgggattacagccgtgagccactactcccagcctctgaccagtgttcttaacctggtccgtggacctccagagagtccatgtacctcctagagctgtttaataataagatgtgggtaatgactgggtgcagtggctcaagcctgtaatcccag

SEQ ID NO: 306504 - DNA, 1709 bp, Homo sapiens
gagtgaggaaaagggaggggtggaggttttggaaagttgtcaaggctctagcaacggagcccaggaccaagaggcttctgagcagttcggcagcccagtggctgaaagggggaaacgtctcccaggagtggccggacagtacctgtttaagtgtttgataaacgttaagaaggaggtggacgatgccttagtggagatgcactgggttgagggccagaacagggatctgatgaaccagctttgcacctacatacgtaaccaaattttcaggcttgttgcagttaactagaaacctcctgcacagttggaaacgtgttgatagtaacttgctttggagtggcctgtggggtggcaagaggaatcctaccagcggcccattagtagcacgatgtggaattatcttcgaaaacaaaaacctatgaatctgtcccccacctccccccgcctccttcccgctttttgagttacagggagtcgtagtgtggtcatttacaaggaggaattgtggtcatcagtaacaacagaaagccctcagtaaactcccgagggattgcaagctggctcaagctggcccctcagctctggactgcctctgcaaggtcagaagggttgtttgtggagtctgggctgggcagcactgcctagaatatcatgctgtctctgtcacccaagggtgtttcttgaggaggggtggctctctctgcctccagctggaggccctggtaccctgttctaggtcactcttcaagatggggcctaccttgcatcaatcccacaaagggagctgtatggtgggtggtggggaatctgggagagaaaccttagtaatgctgggaaggagcagcagagtctggggaccacccggtaaatggcacattcctgacacctggctgttttgatgttgcttatttcagaagcagaattaggtaagcaaaactccccggtgtgactgagacacacagaaggcacccatacccccacctccagcctgttgacagtaccattttgtagcagttttactactgtgtgatttttgtttggacatctgaagtagagcttgttttgtttttaaataagaatattcacaaattaaaaaccagcggtcctatttgaatcctggggttagctgagtgagcggctgatgatagaaatgagaaatagaacaaaatagtatgtgccgtaggtagcttaagaaagtctcagatattttgttgctgatcaaatactgtttttttgtggcttcacttgtaatcccccctgtacttacctactcacattggagagttctgaggccggagtaactgtgtccttgaaacacgtttctaattggaatgccagggttcagtagccgtccccccggaaaggggtgaccttttgctgtgcttgatgttgcatcagcagcctagggttctgtttagactaaaatcttggccagagctccttgccatctgctaagaagactggggctgagtagttaagccagccttctgagaggtggctgttggtcaggacgggaagctggtgaccttggcatgtcttggcagcagctagatcaggccctcggcagagacacaggaagcggaactgctgtgccttaacttggctgtggagctggagctggagaaggcagcatactgaccagtggctttttgattgattgtttgttatgaggtgaggagaggaagtttatactctggagcgagctatga

SEQ ID NO: 306505 - DNA, 783 bp, Homo sapiens
acccagaacagtacctggcacatagtaatcactacgtatgtgtttgttaaacaaatgaattagagatcatttatggaagagtagtatgagagactagagtacaggaacccaatccagcttggagttggggaagaccccctaaaagaggtggcatctgagttcatcctttaaagaaagaaggagtggtcaaggaggcagctgagtacaggtgctcctggccaaatgtgcaaaggcagagtgagagagagcaggcccaggtgagtcacctgtaggtagttgtgaagttggaacaaagtctgggacctacctcctatcactacactattcctgaggctgtgaggagccactgaagcgaggaagacaccatcagatttgtgtcttggaaagactacagtccagcacagtgttttccaaagcaccttcatcagaataacctgggaagcttgtcaaaatgcatgttccaaaaccaaaaaaaaaaaaaaagcacattttgtgcccttccttacagaatcagaatcttggtggtagtggaacccagaaatctgcatctttaacaaactccctgggtgagtctaatgcacacaaaatctaagaactgccaatccagaggcttgtgaaagggtgatgctgggaggcacctcagaggctgttttgctcatctagtagcaagctgagggtggccccaatgaaggtattgaccctgaaaggaagaagcaaagccaagagacgtcatggtggttctgtggaactctagctaattgggtggtgtcgtggggctaggat

SEQ ID NO: 306506 - DNA, 6563 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatat

SEQ ID NO: 306507 - DNA, 717 bp, Homo sapiens
tagaccgtgctaagatgggattgctacaatatgtagtagttggaattacatgatgctagtgtgcctaaatatttattaagaatataatatatacattgcacagtttcagattatgcattgcgtgtggatgtgtttggagagcgtattgtgtataagtataatcagttgtgcgcttataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306508 - DNA, 7480 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306509 - DNA, 5875 bp, Homo sapiens
gaacttttgcatatatccattttctcttgtttttatttatcataagaattccttttatttaatatcaaaatagctttacatttttttctgactagagatgattgaaacactgatgaaaaaagtgacagtcacgcacaatcctgctgtcgagatataaccattgcatattttcatagacctttgaatcatatatttttaatgtttgttaaaacttaggtatttcttccttcttaacaactttcagtaattactaccttaattcctaaaggtttcatgaaaagctgttgctactcttgtttgaggatgttttgtttggacagatgctgggaatatcccttttcttgtagtgttggtatgtgtgtcagctaatgcaatgcctctgaaataagagctgtctgatattatccagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306510 - DNA, 6434 bp, Homo sapiens
aaggcatagaagcctgtgtcctaccctagaactagtgactcattttctggatatggtaccccagaatctatattaaaataaacagaagcctctcaaatgattctagtgcatccctgttaatactggtttccaaagagatattagggtcttactgtcaattccctgataaggtgaatacttattctccattcttttcacactaacaactatacatacacattttgtgaattggtaatacaaatatccatttatttaacatgtaacatgcttttttttttttttaatcacaggtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306511 - DNA, 4036 bp, Homo sapiens
cgcggcgtatgcttcacattctagattttctgcagcacctgctgacgatcgagcccccttttatgtaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306512 - DNA, 4678 bp, Homo sapiens
  misc_feature (9)..(9): n is a, c, g, or t
  misc_feature (20)..(20): n is a, c, g, or t
  misc_feature (23)..(23): n is a, c, g, or t
  misc_feature (29)..(29): n is a, c, g, or t
  misc_feature (31)..(31): n is a, c, g, or t
  misc_feature (34)..(34): n is a, c, g, or t
  misc_feature (43)..(43): n is a, c, g, or t
  misc_feature (58)..(58): n is a, c, g, or t
  misc_feature (78)..(78): n is a, c, g, or t
  misc_feature (90)..(90): n is a, c, g, or t
ggtcatccngttcgacctcncanaagctncnggnagccccccntttgaccaagtccancctggtaagcccaacttgantcccggccaccnattgttgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306513 - DNA, 3597 bp, Homo sapiens
agtggcgtgcacagcgcgaaggaacagcctgggaagtctgggattctcagcaatggatggtaagtaagactgtcatcttgcgagtcttcagaaggctaagtaaactttcaatagggtaaccaacaacaatttcatcatctacagccagtatctgatctccgactttgagtcgtccatccgtggctgctaccccatgctctgttaagctctttatgatgactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306514 - DNA, 7446 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306515 - DNA, 7430 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306516 - DNA, 2913 bp, Homo sapiens
attaaataggtaatttttggcccactaccctaaattaacaatggtgatttaatcacatttgttttatttttaaatataagataattaaaagattgaggtaaatacaaagtctcttttcccacagtcatgggcccatttctctgccccatccctcagagtcaatctgtgtgatgagtttgatggatatgccttagtaaccaatttttatttgtatttcatttttaacttatttttagatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306517 - DNA, 7386 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatataaaataaagaagaaaatctcggggagtttaaaaaaaatgcctcaatttggcaatctacctcctctccccaccccaaactaaaaaaagaaaaaaaggttttctaatgaaaatctttaaaaatactgtcagtattttaaaattttcaacagtattataaaaacattgcatctccccacctctaatatgcatatatatttttcctgctaaaattggtttctacaattgagtaaatggcaaatacatgaagcaatgtccctaaattttataaagaaattatatttaatgcacatttcaattttcattcttatttttgaccttttgtaaaatattttcatgttgctataagtaaatgatgatgccaccccatgttgactatggtttttctagaaagcaactatgctgctaaccatagaggaacatagaagggttccagaatctttagtgctggttttaacaaccgatgcaacattaaaaatgtgttagtgtgctgtgcaattggttttcaattcatattaatcttaatgacagagaacaatgtgttactaattattttggttgtatgccattagtaaattgatagaaaaattaaggggattaacataacttcatttcattgccttatattaacatcttataatacaatagtttaagactaagggaaacagatggagctgtttattgagacaactggtgaggaattatcatgtgttcattcccattttagagcgtgaaactcctacattagaatatataaagtcactttaaatatctatatttgtaacagaagtagtgtacagatattttattacagcatttttgtgtaaatgcagaattaaagtgaataaataagaattttcagtggtgcacaaataaaaagaaagca

SEQ ID NO: 306518 - DNA, 6597 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaaattaggatgaaaaatgaaaatat

SEQ ID NO: 306519 - DNA, 5604 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggtccattccattcagagaggaggccatctcaaagcagccaggtgagtgaaggcagcctgtcatctttcacttttccactctctggatccagtacatctgagtcactggaaagtagctcaaagaagaatgcattggcatctgaaatacagggattaagcagtcgtgacacttggtgatgtgcct

SEQ ID NO: 306520 - DNA, 5059 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctggtgccattattatccatgaagtttaacagcagtgggggtacttaacaatacctgataagg

SEQ ID NO: 306521 - DNA, 4177 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtaccctctagtgagcctgtgctaaaatttgtttgttttgttttatttatttattttttaattttactattattatactttaagttttagggtacatgtgctaaaatttttcacctgctccaccctttgtactgagggaattgtcatcttcatactagttactcaacccagcattcgagtaaaatgtgtgtgtggataaattatttctttcttatttgtttattttcatacgtaattttctcttatgtatataatgacagattatatgttttgatatagagactgatgtttggagataaagccaaccatttaaaaaaaaatggctccaaggtaaaataattatgttctgtttgaaagaacaaagcacaattctcagggaaaaattttgaattaagattacattagacatacaatatatgtatatgtacacacaaaaatgtagatataattaagttaatgagattttatttttccaagtgagtcttttttagtaaaatattt

SEQ ID NO: 306522 - DNA, 3511 bp, Homo sapiens
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccaggatcaccagaacgagaacggcgcctgtagtgcgcacccaggcgcacttctcacctggcactgtccccggagcggtcgcgcccggccgagaaagtg

SEQ ID NO: 306523 - DNA, 241 bp, Homo sapiens
agttgcaaggcagcattttttgagaaataaacaagtctactttataatttgcagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcac

SEQ ID NO: 306524 - DNA, 379 bp, Homo sapiens
ttgggcgaagagtctgacgtgatacagcgggttctgatcagagaatccttggtacaggatgttaagatgtggagatttctgtagtttgctgctaacttaattgccttgactgtttcagggtatccattactgtcagctgagatagaagaaatagaagatgcacaaaaacaagaagctgctctgctgacaaaatggcaaaggattatgggaattaactatgaaatagtggtaggttagctgaccttctgtaattttctaacttgtaactgtatttgagcaggcagttcgagggaataatagaggcaatcattagagttccagagaagaatcaaatgtacaggccttttttagacaacctaaatatggtgatccaggtaat

SEQ ID NO: 306525 - DNA, 762 bp, Homo sapiens
cgtgctgcgcttggctggctgtggagtcggccgaagctttcggcggcggctgagccagctgaggggaaaaatggctcggactgtggcggcttcggcggctcaggttgtggtagaggcggaggctcaggcagcttgaggattcgactacatatataaagcagtgctgtacatgagaaatatgtgagccaaaaatgggagtcacataggttccttgtgtcctcacgttggcaggcagatacctactctgaagcctttgtaggagcctgagcacctttgcgaacctgagctggaactgaagctggagttgcagcctgggccttggtttgatccttgtccttgtcgtttggccggcacaacccaagccccttggcaatgcgggcacaagcacgcttcccaagcttggggtgggcaatgtaggcaagtcgatggagcttgctgctgacaccctttgggatcttgggcttaacctcctttacaagggccttcatagcctcaccacgtggactgatggcctgccaaagcctgcatcttctttaggcccttcttgttttgcttcttggcaatgcacatgttcctcaggaatttggggtccaccccattgagagagtcatatctttgtgatcggggtatcttttctctttcttttgtctgatctttgcttttgttttcttttcttttctcttttcttttcttttctttttttgagacagagtctcgctctgttgccaggctggagcgcagtggtgcgatctcggctcactg

SEQ ID NO: 306526 - DNA, 455 bp, Homo sapiens
ggtacccttagcacttcctgtactttttttcaccgtttgacaactgggcattttataaattgtatccacagcataacttgtctgaaaaatagatcttcattttcattatgtacttacagtatcacatctctttctataggttgttctccaaagaagtatggaacgagtacagtccttttttcagaaaaataaatgccgtctccctctcaagccaagtctagtggcaaaagaattaaatattaaggtgacacataaaatacttataagttcatattacatttgaaaataataggaagaaggcaaatgggcaggtatgcttaaggcaaatgaaggtaaaacctgcacaggttggttataagcatggatggttgtgattaggatccatatttatcttagcatatttttttacctaaccaccattcctgggaaaaaaaaagtataaaattatttactgc

SEQ ID NO: 306527 - DNA, 8428 bp, Homo sapiens
cgtgctgcgcttggctggctgtggagtcggccgaagctttcggcggcggctgagccagctgaggggaaaaatggctcggactgtggcggcttcggcggctcaggttgtggtagaggcggaggctcaggcagcttgaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcgcaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaataatcattgccttggaagtcatgagcatattcaaaactgtcgaaaatgggacacagaaattagactacaactcttgaccttcagtgcaatgtgtcaaaatctggcccgaacagcagaagatgatgaaacacccgtggatttaaacaaacacctgtatcaaatagaaaaaccttgcaaagaagccatgacgagacaccctgttgaagaactcttagattcttatcacaaccaagtagaactggctcttcaaattgaaaaccaacaccgagcagtagatcaagtaattaaagctgtaagaaaaatctgtagtgctttagatggtgtcgagactcttgccattacagaatcagtaaagaagctaaagagagcagttaatcttccaaggagtaaaactgctgatgtgacttctttgtttggaggagaagacactagcaggagttcaactaggggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaattatgaaaaatactacttgatatgttcactgtctcacaatggaaaggatctttttaaacctattcaatcaaagaaggttggcacttacaagaatttcttctatcttattaaatgggatgaactaatcatttttcctatccagatatcacaattgccattagaatcagttcttcaccttactctttttggaattttaaatcagagcagtggaagttcccctgattctaataagcagagaaagggaccagaagctttgggcaaagtttctttacctctttgtgactttagacggtttttaacatgtggaactaaacttctatatctttggacttcatcacatacaaattctgttcctggaacagttaccaaaaaaggatatgtcatggaaagaatagtgctacaggttgattttccttctcctgcatttgatattatttatacaactcctcaagttgacagaagcattatacagcaacataacttagaaacactagagaatgatataaaagggaaacttcttgatattcttcataaagactcatcacttggactttctaaagaagataaagcttttttatgggagaaacgttattattgcttcaaacacccaaattgtcttcctaaaatattagcaagcgccccaaactggaaatggggtaatcttgccaaaacttactcattgcttcaccagtggcctgcattgtacccactaattgcattggaacttcttgattcaaaatttgctgatcaggaagtaagatccctagctgtgacctggattgaggccattagtgatgatgagctaacagatcttcttccacagtttgtacaagctttgaaatatgaaatttacttgaatagttcattagtgcaattccttttgtccagggcattgggaaatatccagatagcacacaatttatattggcttctcaaagatgccctgcatgatgtacagtttagtacccgatacgaacatgttttgggtgctctcctgtcagtaggaggaaaacgacttagagaagaacttctaaaacagacgaaacttgtacagcttttaggaggagtagcagaaaaagtaaggcaggctagtggatcagccagacaggttgttctccaaagaagtatggaacgagtacagtccttttttcagaaaaataaatgccgtctccctctcaagccaagtctagtggcaaaagaattaaatattaagtcgtgttccttcttcagttctaatgctgtccccctaaaagtcacaatggtgaatgctgaccctatgggagaagaaattaatgtcatgtttaaggttggtgaagatcttcggcaagatatgttagctttacagatgataaagattatggataagatctggcttaaagaaggactagatctgaggatggtaattttcaaatgtctctcaactggcagagatcgaggcatggtggagctggttcctgcttccgataccctcaggaaaatccaagtggaatatggtgtgacaggatcctttaaagataaaccacttgcagagtggctaaggaaatacaatccctctgaagaagaatatgaaaaggcttcagagaactttatctattcctgtgctggatgctgtgtagccacctatgttttaggcatctgtgatcgacacaatgacaatataatgcttcgaagcacgggacacatgtttcacattgactttggaaagtttttgggacatgcacagatgtttggcagcttcaaaagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactgatgattccttcagggttaccagaacttacaagtattcaagatttgaaatacgttagagatgcacttcaaccccaaactacagacgcagaagctacaattttctttactaggcttattgaatcaagtttgggaagcattgccacaaagtttaacttcttcattcacaaccttgctcagcttcgtttttctggtcttccttctaatgatgagcccatcctttcattttcacctaaaacatactcctttagacaagatggtcgaatcaaggaagtctctgtttttacatatcataagaaatacaacccagataaacattatatttatgtagtccgaattttgagggaaggacagattgaaccatcatttgtcttccgaacatttgacgaatttcaggaacttcacaataagctcagtattatttttccactttggaagttaccaggctttcctaataggatggttctaggaagaacacacataaaagatgtagcagccaaaaggaaaattgagttaaacagttacttacagagtttgatgaatgcttcaacggatgtagcagagtgtgatcttgtttgtactttcttccaccctttacttcgtgatgagaaagctgaagggatagctaggtctgcagatgcaggttccttcagtcctactccaggccaaataggaggagctgtgaaattatccatctcttaccgaaatggtactcttttcatcatggtgatgcatatcaaagatcttgttactgaagatggagctgacccaaatccatatgtcaaaacatacctacttccagataaccacaaaacatccaaacgtaaaaccaaaatttcacgaaaaacgaggaatccgacattcaatgaaatgcttgtatacagtggatatagcaaagaaaccctaagacagcgagaacttcaactaagtgtactcagtgcagaatctctgcgggagaattttttcttgggtggagtaaccctgcctttgaaagatttcaacttgagcaaagagacggttaaatggtatcagctgactgcggcaacatacttgtaaactagtgaatgtctgagctttggaagcatgaacagttataaacgtgcatgcatacatgcacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagtaaaggaaaaatgcaggatgttaccgtaaaatccagctgctattcatggagctgaaaaacaaagcacaaataatagatagctaagttaagaactactaagtagtttatagaagtagggaaaaacgtaatactgctttttattcatgtctttaaagcctttttcagaataagtgccaatcactgatgttgtaaataatggtgccttaactttatatgcttccctggcacttcgtttctgatttttttcctgatttgataaataattagtacatagttttcactcacttgcagcttactaaagacaagaaattatgtacatgtactaatgtttttcccacaaaaaaatcctttacttctgatgtatgaattagttatctaaatagttaagcctaatacctgaataagactcaccaatgtgattgtacaataaattctatcattccattaaaatcctacatttattcccaggaatggtaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaaaagttattttcctttatataattggattcagaatcataagggacaggactgaaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaatcccagctacttggggggctgaggcaggagaatcgcttgaacccaggaggcggaggttgcagtgagccgagatcacgccactgcactcccgcctgggtgacaagagcaaaactccatcttaaaaaaaaagaaaaaaagagtaagattcatttttattagttactcaacttcagacacaattttgttaatttggatatatacatatatataataagaactcatggttagaatagaaatacagatactttaaaaatggtaatagaaattgtaccaatcaggttgctgtgagaaaactgacaaaatatgcaataaagaataccaagagagaaaggacaatcgccaattcagtttcccagaacagaatttttatgaactgcacaaatgtttaatgtaaatggtgatacctacagggaagaaatagaagagttgataatatatcactgggacggggtgggggaaagacttgaaatttttggtgcctaacactaatggtccatatgtagttaaacccatgagtatggtatatgaatgtcttttttaaatgttaaaatgtgttgtctatttaataagttaattaaaatgcagatcaaagcaccaccatttgctttttccacagatcattaacatttccttaaagtatgtaagtacctttgcaaatgcaaatgtactagtaattttcacttaagcttttgagaccgaattccattccaccagttatcacttagccactgtaatttaaaaacaaacaaacaaacaaaaactgtcttggtagaggtcgttaattagactcaacatgtactgcctttttgcagtctattatgacagtgtcttttagcacaaataatagagctaaaaaatgtcctgtcacttccattataagaaatctggattcatatctaagtgtatattataatactgtacagttaagagttcagaacaagtggtaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctataagaaccaaatactttaattatattaagatagtgaataaagatgtataatatttttattaataccttgaatatattcagtggattgaatgtgacttcataactgtactacgattgtattaaaatatttctggaataaaa

SEQ ID NO: 306528 - DNA, 8374 bp, Homo sapiens
cgtgctgcgcttggctggctgtggagtcggccgaagctttcggcggcggctgagccagctgaggggaaaaatggctcggactgtggcggcttcggcggctcaggttgtggtagaggcggaggctcaggcagcttgaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcgcaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaataatcattgccttggaagtcatgagcatattcaaaactgtcgaaaatgggacacagaaattagactacaactcttgaccttcagtgcaatgtgtcaaaatctggcccgaacagcagaagatgatgaaacacccgtggatttaaacaaacacctgtatcaaatagaaaaaccttgcaaagaagccatgacgagacaccctgttgaagaactcttagattcttatcacaaccaagtagaactggctcttcaaattgaaaaccaacaccgagcagtagatcaagtaattaaagctgtaagaaaaatctgtagtgctttagatggtgtcgagactcttgccattacagaatcagtaaagaagctaaagagagcagttaatcttccaaggagtaaaactgctgatgtgacttctttgtttggaggagaagacactagcaggagttcaactaggggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaattatgaaaaatactacttgatatgttcactgtctcacaatggaaaggatctttttaaacctattcaatcaaagaaggttggcacttacaagaatttcttctatcttattaaatgggatgaactaatcatttttcctatccagatatcacaattgccattagaatcagttcttcaccttactctttttggaattttaaatcagagcagtggaagttcccctgattctaataagcagagaaagggaccagaagctttgggcaaagtttctttacctctttgtgactttagacggtttttaacatgtggaactaaacttctatatctttggacttcatcacatacaaattctgttcctggaacagttaccaaaaaaggatatgtcatggaaagaatagtgctacaggttgattttccttctcctgcatttgatattatttatacaactcctcaagttgacagaagcattatacagcaacataacttagaaacactagagaatgatataaaagggaaacttcttgatattcttcataaagactcatcacttggactttctaaagaagataaagcttttttatgggagaaacgttattattgcttcaaacacccaaattgtcttcctaaaatattagcaagcgccccaaactggaaatggggtaatcttgccaaaacttactcattgcttcaccagtggcctgcattgtacccactaattgcattggaacttcttgattcaaaatttgctgatcaggaagtaagatccctagctgtgacctggattgaggccattagtgatgatgagctaacagatcttcttccacagtttgtacaagctttgaaatatgaaatttacttgaatagttcattagtgcaattccttttgtccagggcattgggaaatatccagatagcacacaatttatattggcttctcaaagatgccctgcatgatgtacagtttagtacccgatacgaacatgttttgggtgctctcctgtcagtaggaggaaaacgacttagagaagaacttctaaaacagacgaaacttgtacagcttttaggaggagtagcagaaaaagtaaggcaggctagtggatcagccagacaggttgttctccaaagaagtatggaacgagtacagtccttttttcagaaaaataaatgccgtctccctctcaagccaagtctagtggcaaaagaattaaatattaagtcgtgttccttcttcagttctaatgctgtccccctaaaagtcacaatggtgaatgctgaccctatgggagaagaaattaatgtcatgtttaaggttggtgaagatcttcggcaagatatgttagctttacagatgataaagattatggataagatctggcttaaagaaggactagatctgaggatggtaattttcaaatgtctctcaactggcagagatcgaggcatggtggagctggttcctgcttccgataccctcaggaaaatccaagtggaatatggtgtgacaggatcctttaaagataaaccacttgcagagtggctaaggaaatacaatccctctgaagaagaatatgaaaaggcttcagagaactttatctattcctgtgctggatgctgtgtagccacctatgttttaggcatctgtgatcgacacaatgacaatataatgcttcgaagcacgggacacatgtttcacattgactttggaaagtttttgggacatgcacagatgtttggcagcttcaaaagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactgatgattccttcagggttaccagaacttacaagtattcaagatttgaaatacgttagagatgcacttcaaccccaaactacagacgcagaagctacaattttctttactaggcttattgaatcaagtttgggaagcattgccacaaagtttaacttcttcattcacaaccttgctcagcttcgtttttctggtcttccttctaatgatgagcccatcctttcattttcacctaaaacatactcctttagacaagatggtcgaatcaaggaagtctctgtttttacatatcataagaaatacaacccagataaacattatatttatgtagtccgaattttgagggaaggacagattgaaccatcatttgtcttccgaacatttgacgaatttcaggaacttcacaataagctcagtattatttttccactttggaagttaccaggctttcctaataggatggttctaggaagaacacacataaaagatgtagcagccaaaaggaaaattgagttaaacagttacttacagagtttgatgaatgcttcaacggatgtagcagagtgtgatcttgtttgtactttcttccaccctttacttcgtgatgagaaagctgaagggatagctaggtctgcagatgcaggttccttcagtcctactccaggccaaataggaggagctgtgaaattatccatctcttaccgaaatggtactcttttcatcatggtgatgcatatcaaagatcttgttactgaagatggagctgacccaaatccatatgtcaaaacatacctacttccagataaccacaaaacatccaaacgtaaaaccaaaatttcacgaaaaacgaggaatccgacattcaatgaaatgcttgtatacagtggatatagcaaagaaaccctaagacagcgagaacttcaactaagtgtactcagtgcagaatctctgcgggagaattttttcttgggtggagtaaccctgcctttgaaagatttcaacttgagcaaagagacggttaaatggtatcagctgactgcggcaacatacttgtaaactagtgaatgtctgagctttggaagcatgaacagttataaacgtgcatgcatacatgcacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagtaaaggaaaaatgcaggatgttaccgtaaaatccagctgctattcatggagctgaaaaacaaagcacaaataatagatagctaagttaagaactactaagtagtttatagaagtagggaaaaacgtaatactgctttttattcatgtctttaaagcctttttcagaataagtgccaatcactgatgttgtaaataatggtgccttaactttatatgcttccctggcacttcgtttctgatttttttcctgatttgataaataattagtacatagttttcactcacttgcagcttactaaagacaagaaattatgtacatgtactaatgtttttcccacaaaaaaatcctttacttctgatgtatgaattagttatctaaatagttaagcctaatacctgaataagactcaccaatgtgattgtacaataaattctatcattccattaaaatcctacatttattcccaggaatggtaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaatcccagctacttggggggctgaggcaggagaatcgcttgaacccaggaggcggaggttgcagtgagccgagatcacgccactgcactcccgcctgggtgacaagagcaaaactccatcttaaaaaaaaagaaaaaaagagtaagattcatttttattagttactcaacttcagacacaattttgttaatttggatatatacatatatataataagaactcatggttagaatagaaatacagatactttaaaaatggtaatagaaattgtaccaatcaggttgctgtgagaaaactgacaaaatatgcaataaagaataccaagagagaaaggacaatcgccaattcagtttcccagaacagaatttttatgaactgcacaaatgtttaatgtaaatggtgatacctacagggaagaaatagaagagttgataatatatcactgggacggggtgggggaaagacttgaaatttttggtgcctaacactaatggtccatatgtagttaaacccatgagtatggtatatgaatgtcttttttaaatgttaaaatgtgttgtctatttaataagttaattaaaatgcagatcaaagcaccaccatttgctttttccacagatcattaacatttccttaaagtatgtaagtacctttgcaaatgcaaatgtactagtaattttcacttaagcttttgagaccgaattccattccaccagttatcacttagccactgtaatttaaaaacaaacaaacaaacaaaaactgtcttggtagaggtcgttaattagactcaacatgtactgcctttttgcagtctattatgacagtgtcttttagcacaaataatagagctaaaaaatgtcctgtcacttccattataagaaatctggattcatatctaagtgtatattataatactgtacagttaagagttcagaacaagtggtaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctataagaaccaaatactttaattatattaagatagtgaataaagatgtataatatttttattaataccttgaatatattcagtggattgaatgtgacttcataactgtactacgattgtattaaaatatttctggaataaaa

SEQ ID NO: 306529 - DNA, 8765 bp, Homo sapiens
cgtgctgcgcttggctggctgtggagtcggccgaagctttcggcggcggctgagccagctgaggggaaaaatggctcggactgtggcggcttcggcggctcaggttgtggtagaggcggaggctcaggcagcttgaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcgcaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaataatcattgccttggaagtcatgagcatattcaaaactgtcgaaaatgggacacagaaattagactacaactcttgaccttcagtgcaatgtgtcaaaatctggcccgaacagcagaagatgatgaaacacccgtggatttaaacaaacacctgtatcaaatagaaaaaccttgcaaagaagccatgacgagacaccctgttgaagaactcttagattcttatcacaaccaagtagaactggctcttcaaattgaaaaccaacaccgagcagtagatcaagtaattaaagctgtaagaaaaatctgtagtgctttagatggtgtcgagactcttgccattacagaatcagtaaagaagctaaagagagcagttaatcttccaaggagtaaaactgctgatgtgacttctttgtttggaggagaagacactagcaggagttcaactaggggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaattatgaaaaatactacttgatatgttcactgtctcacaatggaaaggatctttttaaacctattcaatcaaagaaggttggcacttacaagaatttcttctatcttattaaatgggatgaactaatcatttttcctatccagatatcacaattgccattagaatcagttcttcaccttactctttttggaattttaaatcagagcagtggaagttcccctgattctaataagcagagaaagggaccagaagctttgggcaaagtttctttacctctttgtgactttagacggtttttaacatgtggaactaaacttctatatctttggacttcatcacatacaaattctgttcctggaacagttaccaaaaaaggatatgtcatggaaagaatagtgctacaggttgattttccttctcctgcatttgatattatttatacaactcctcaagttgacagaagcattatacagcaacataacttagaaacactagagaatgatataaaagggaaacttcttgatattcttcataaagactcatcacttggactttctaaagaagataaagcttttttatgggagaaacgttattattgcttcaaacacccaaattgtcttcctaaaatattagcaagcgccccaaactggaaatggggtaatcttgccaaaacttactcattgcttcaccagtggcctgcattgtacccactaattgcattggaacttcttgattcaaaatttgctgatcaggaagtaagatccctagctgtgacctggattgaggccattagtgatgatgagctaacagatcttcttccacagtttgtacaagctttgaaatatgaaatttacttgaatagttcattagtgcaattccttttgtccagggcattgggaaatatccagatagcacacaatttatattggcttctcaaagatgccctgcatgatgtacagtttagtacccgatacgaacatgttttgggtgctctcctgtcagtaggaggaaaacgacttagagaagaacttctaaaacagacgaaacttgtacagcttttaggaggagtagcagaaaaagtaaggcaggctagtggatcagccagacaggttgttctccaaagaagtatggaacgagtacagtccttttttcagaaaaataaatgccgtctccctctcaagccaagtctagtggcaaaagaattaaatattaagtcgtgttccttcttcagttctaatgctgtccccctaaaagtcacaatggtgaatgctgaccctatgggagaagaaattaatgtcatgtttaaggttggtgaagatcttcggcaagatatgttagctttacagatgataaagattatggataagatctggcttaaagaaggactagatctgaggatggtaattttcaaatgtctctcaactggcagagatcgaggcatggtggagctggttcctgcttccgataccctcaggaaaatccaagtggaatatggtgtgacaggatcctttaaagataaaccacttgcagagtggctaaggaaatacaatccctctgaagaagaatatgaaaaggcttcagagaactttatctattcctgtgctggatgctgtgtagccacctatgttttaggcatctgtgatcgacacaatgacaatataatgcttcgaagcacgggacacatgtttcacattgactttggaaagtttttgggacatgcacagatgtttggcagcttcaaaagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactgatgattccttcagggttaccagaacttacaagtattcaagatttgaaatacgttagagatgcacttcaaccccaaactacagacgcagaagctacaattttctttactaggcttattgaatcaagtttgggaagcattgccacaaagtttaacttcttcattcacaaccttgctcagcttcgtttttctggtcttccttctaatgatgagcccatcctttcattttcacctaaaacatactcctttagacaagatggtcgaatcaaggaagtctctgtttttacatatcataagaaatacaacccagataaacattatatttatgtagtccgaattttgagggaaggacagattgaaccatcatttgtcttccgaacatttgacgaatttcaggaacttcacaataagctcagtattatttttccactttggaagttaccaggctttcctaataggatggttctaggaagaacacacataaaagatgtagcagccaaaaggaaaattgagttaaacagttacttacagagtttgatgaatgcttcaacggatgtagcagagtgtgatcttgtttgtactttcttccaccctttacttcgtgatgagaaagctgaagggatagctaggtctgcagatgcaggttccttcagtcctactccaggccaaataggaggagctgtgaaattatccatctcttaccgaaatggtactcttttcatcatggtgatgcatatcaaagatcttgttactgaagatggagctgacccaaatccatatgtcaaaacatacctacttccagataaccacaaaacatccaaacgtaaaaccaaaatttcacgaaaaacgaggaatccgacattcaatgaaatgcttgtatacagtggatatagcaaagaaaccctaagacagcgagaacttcaactaagtgtactcagtgcagaatctctgcgggagaattttttcttgggtggagtaaccctgcctttgaaagatttcaacttgagcaaagagacggttaaatggtatcagctgactgcggcaacatacttgtaaactagtgaatgtctgagctttggaagcatgaacagttataaacgtgcatgcatacatgcacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagtaaaggaaaaatgcaggatgttaccgtaaaatccagctgctattcatggagctgaaaaacaaagcacaaataatagatagctaagttaagaactactaagtagtttatagaagtagggaaaaacgtaatactgctttttattcatgtctttaaagcctttttcagaataagtgccaatcactgatgttgtaaataatggtgccttaactttatatgcttccctggcacttcgtttctgatttttttcctgatttgataaataattagtacatagttttcactcacttgcagcttactaaagacaagaaattatgtacatgtactaatgtttttcccacaaaaaaatcctttacttctgatgtatgaattagttatctaaatagttaagcctaatacctgaataagactcaccaatgtgattgtacaataaattctatcattccattaaaatcctacatttattcccaggaatggtaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaaaagttattttcctttatataattggattcagaatcataagggacaggactgaaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaatcccagctacttggggggctgaggcaggagaatcgcttgaacccaggaggcggaggttgcagtgagccgagatcacgccactgcactcccgcctgggtgacaagagcaaaactccatcttaaaaaaaaagaaaaaaagagtaagattcatttttattagttactcaacttcagacacaattttgttaatttggatatatacatatatataataagaactcatggttagaatagaaatacagatactttaaaaatggtaatagaaattgtaccaatcaggttgctgtgagaaaactgacaaaatatgcaataaagaataccaagagagaaaggacaatcgccaattcagtttcccagaacagaatttttatgaactgcacaaatgtttaatgtaaatggtgatacctacagggaagaaatagaagagttgataatatatcactgggacggggtgggggaaagacttgaaatttttggtgcctaacactaatggtccatatgtagttaaacccatgagtatggtatatgaatgtcttttttaaatgttaaaatgtgttgtctatttaataagttaattaaaatgcagatcaaagcaccaccatttgctttttccacagatcattaacatttccttaaagtatgtaagtacctttgcaaatgcaaatgtactagtaattttcacttaagcttttgagaccgaattccattccaccagttatcacttagccactgtaatttaaaaacaaacaaacaaacaaaaactgtcttggtagaggtcgttaattagactcaacatgtactgcctttttgcagtctattatgacagtgtcttttagcacaaataatagagctaaaaaatgtcctgtcacttccattataagaaatctggattcatatctaagtgtatattataatactgtacagttaagagttcagaacaagtggtaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctataagaaccaaatactttaattatattaagatagtgaataaagatgtataatatttttattaataccttgaatatattcagtggattgaatgtgacttcataactgtactacgattgtattaaaatatttctggaataaaaaaaaaaaaaaaaaaaaaaaaaaaaaaaaaaaaaaaaaaaaaaaaaaaaaaaaaaaaaaaaacaacaagaataagagacacaaaaacacatgctgtgtgggcggcgcgccgcgtcggcccgcgcacaaaaaaaaaggtttggagaagacaaacaagtggagggggacgggcggagcgccccacaggagagaagataggaagcaagagacgagcaaaaaaagttggtgtgcgaacagaaaaaacacgggggagtaccataacaagggggcgggaactgaccacgacagagaaaaaaaaagcgccggcgggggagacaaaagacgggggtgggaaacaca

SEQ ID NO: 306530 - DNA, 8374 bp, Homo sapiens
cgtgctgcgcttggctggctgtggagtcggccgaagctttcggcggcggctgagccagctgaggggaaaaatggctcggactgtggcggcttcggcggctcaggttgtggtagaggcggaggctcaggcagcttgaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcgcaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaataatcattgccttggaagtcatgagcatattcaaaactgtcgaaaatgggacacagaaattagactacaactcttgaccttcagtgcaatgtgtcaaaatctggcccgaacagcagaagatgatgaaacacccgtggatttaaacaaacacctgtatcaaatagaaaaaccttgcaaagaagccatgacgagacaccctgttgaagaactcttagattcttatcacaaccaagtagaactggctcttcaaattgaaaaccaacaccgagcagtagatcaagtaattaaagctgtaagaaaaatctgtagtgctttagatggtgtcgagactcttgccattacagaatcagtaaagaagctaaagagagcagttaatcttccaaggagtaaaactgctgatgtgacttctttgtttggaggagaagacactagcaggagttcaactaggggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaattatgaaaaatactacttgatatgttcactgtctcacaatggaaaggatctttttaaacctattcaatcaaagaaggttggcacttacaagaatttcttctatcttattaaatgggatgaactaatcatttttcctatccagatatcacaattgccattagaatcagttcttcaccttactctttttggaattttaaatcagagcagtggaagttcccctgattctaataagcagagaaagggaccagaagctttgggcaaagtttctttacctctttgtgactttagacggtttttaacatgtggaactaaacttctatatctttggacttcatcacatacaaattctgttcctggaacagttaccaaaaaaggatatgtcatggaaagaatagtgctacaggttgattttccttctcctgcatttgatattatttatacaactcctcaagttgacagaagcattatacagcaacataacttagaaacactagagaatgatataaaagggaaacttcttgatattcttcataaagactcatcacttggactttctaaagaagataaagcttttttatgggagaaacgttattattgcttcaaacacccaaattgtcttcctaaaatattagcaagcgccccaaactggaaatggggtaatcttgccaaaacttactcattgcttcaccagtggcctgcattgtacccactaattgcattggaacttcttgattcaaaatttgctgatcaggaagtaagatccctagctgtgacctggattgaggccattagtgatgatgagctaacagatcttcttccacagtttgtacaagctttgaaatatgaaatttacttgaatagttcattagtgcaattccttttgtccagggcattgggaaatatccagatagcacacaatttatattggcttctcaaagatgccctgcatgatgtacagtttagtacccgatacgaacatgttttgggtgctctcctgtcagtaggaggaaaacgacttagagaagaacttctaaaacagacgaaacttgtacagcttttaggaggagtagcagaaaaagtaaggcaggctagtggatcagccagacaggttgttctccaaagaagtatggaacgagtacagtccttttttcagaaaaataaatgccgtctccctctcaagccaagtctagtggcaaaagaattaaatattaagtcgtgttccttcttcagttctaatgctgtccccctaaaagtcacaatggtgaatgctgaccctatgggagaagaaattaatgtcatgtttaaggttggtgaagatcttcggcaagatatgttagctttacagatgataaagattatggataagatctggcttaaagaaggactagatctgaggatggtaattttcaaatgtctctcaactggcagagatcgaggcatggtggagctggttcctgcttccgataccctcaggaaaatccaagtggaatatggtgtgacaggatcctttaaagataaaccacttgcagagtggctaaggaaatacaatccctctgaagaagaatatgaaaaggcttcagagaactttatctattcctgtgctggatgctgtgtagccacctatgttttaggcatctgtgatcgacacaatgacaatataatgcttcgaagcacgggacacatgtttcacattgactttggaaagtttttgggacatgcacagatgtttggcagcttcaaaagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactgatgattccttcagggttaccagaacttacaagtattcaagatttgaaatacgttagagatgcacttcaaccccaaactacagacgcagaagctacaattttctttactaggcttattgaatcaagtttgggaagcattgccacaaagtttaacttcttcattcacaaccttgctcagcttcgtttttctggtcttccttctaatgatgagcccatcctttcattttcacctaaaacatactcctttagacaagatggtcgaatcaaggaagtctctgtttttacatatcataagaaatacaacccagataaacattatatttatgtagtccgaattttgagggaaggacagattgaaccatcatttgtcttccgaacatttgacgaatttcaggaacttcacaataagctcagtattatttttccactttggaagttaccaggctttcctaataggatggttctaggaagaacacacataaaagatgtagcagccaaaaggaaaattgagttaaacagttacttacagagtttgatgaatgcttcaacggatgtagcagagtgtgatcttgtttgtactttcttccaccctttacttcgtgatgagaaagctgaagggatagctaggtctgcagatgcaggttccttcagtcctactccaggccaaataggaggagctgtgaaattatccatctcttaccgaaatggtactcttttcatcatggtgatgcatatcaaagatcttgttactgaagatggagctgacccaaatccatatgtcaaaacatacctacttccagataaccacaaaacatccaaacgtaaaaccaaaatttcacgaaaaaccctaagacagcgagaacttcaactaagtgtactcagtgcagaatctctgcgggagaattttttcttgggtggagtaaccctgcctttgaaagatttcaacttgagcaaagagacggttaaatggtatcagctgactgcggcaacatacttgtaaactagtgaatgtctgagctttggaagcatgaacagttataaacgtgcatgcatacatgcacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagtaaaggaaaaatgcaggatgttaccgtaaaatccagctgctattcatggagctgaaaaacaaagcacaaataatagatagctaagttaagaactactaagtagtttatagaagtagggaaaaacgtaatactgctttttattcatgtctttaaagcctttttcagaataagtgccaatcactgatgttgtaaataatggtgccttaactttatatgcttccctggcacttcgtttctgatttttttcctgatttgataaataattagtacatagttttcactcacttgcagcttactaaagacaagaaattatgtacatgtactaatgtttttcccacaaaaaaatcctttacttctgatgtatgaattagttatctaaatagttaagcctaatacctgaataagactcaccaatgtgattgtacaataaattctatcattccattaaaatcctacatttattcccaggaatggtaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaaaagttattttcctttatataattggattcagaatcataagggacaggactgaaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaatcccagctacttggggggctgaggcaggagaatcgcttgaacccaggaggcggaggttgcagtgagccgagatcacgccactgcactcccgcctgggtgacaagagcaaaactccatcttaaaaaaaaagaaaaaaagagtaagattcatttttattagttactcaacttcagacacaattttgttaatttggatatatacatatatataataagaactcatggttagaatagaaatacagatactttaaaaatggtaatagaaattgtaccaatcaggttgctgtgagaaaactgacaaaatatgcaataaagaataccaagagagaaaggacaatcgccaattcagtttcccagaacagaatttttatgaactgcacaaatgtttaatgtaaatggtgatacctacagggaagaaatagaagagttgataatatatcactgggacggggtgggggaaagacttgaaatttttggtgcctaacactaatggtccatatgtagttaaacccatgagtatggtatatgaatgtcttttttaaatgttaaaatgtgttgtctatttaataagttaattaaaatgcagatcaaagcaccaccatttgctttttccacagatcattaacatttccttaaagtatgtaagtacctttgcaaatgcaaatgtactagtaattttcacttaagcttttgagaccgaattccattccaccagttatcacttagccactgtaatttaaaaacaaacaaacaaacaaaaactgtcttggtagaggtcgttaattagactcaacatgtactgcctttttgcagtctattatgacagtgtcttttagcacaaataatagagctaaaaaatgtcctgtcacttccattataagaaatctggattcatatctaagtgtatattataatactgtacagttaagagttcagaacaagtggtaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctataagaaccaaatactttaattatattaagatagtgaataaagatgtataatatttttattaataccttgaatatattcagtggattgaatgtgacttcataactgtactacgattgtattaaaatatttctggaataaaa

SEQ ID NO: 306531 - DNA, 6920 bp, Homo sapiens
ttaaatgctcagacttgattttaaaactgtctctgtttcaccattctcttcaatttctgatgcaggtgcaatttaaattttaccctcacctttataatttctaatttgaatagaatagtgaataattaatatatcttaacagtaatcattgccttggaagtcatgagcatattcaaaactgtcgaaaatgggacacagaaattagactacaactcttgaccttcagtgcaatgtgtcaaaatctggcccgaacagcagaagatgatgaaacacccgtggatttaaacaaacacctgtatcaaatagaaaaaccttgcaaagaagccatgacgagacaccctgttgaagaactcttagattcttatcacaaccaagtagaactggctcttcaaattgaaaaccaacaccgagcagtagatcaagtaattaaagctgtaagaaaaatctgtagtgctttagatggtgtcgagactcttgccattacagaatcagtaaagaagctaaagagagcagttaatcttccaaggagtaaaactgctgatgtgacttctttgtttggaggagaagacactagcaggagttcaactaggggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaattatgaaaaatactacttgatatgttcactgtctcacaatggaaaggatctttttaaacctattcaatcaaagaaggttggcacttacaagaatttcttctatcttattaaatgggatgaactaatcatttttcctatccagatatcacaattgccattagaatcagttcttcaccttactctttttggaattttaaatcagagcagtggaagttcccctgattctaataagcagagaaagggaccagaagctttgggcaaagtttctttacctctttgtgactttagacggtttttaacatgtggaactaaacttctatatctttggacttcatcacatacaaattctgttcctggaacagttaccaaaaaaggatatgtcatggaaagaatagtgctacaggttgattttccttctcctgcatttgatattatttatacaactcctcaagttgacagaagcattatacagcaacataacttagaaacactagagaatgatataaaagggaaacttcttgatattcttcataaagactcatcacttggactttctaaagaagataaagcttttttatgggagaaacgttattattgcttcaaacacccaaattgtcttcctaaaatattagcaagcgccccaaactggaaatggggtaatcttgccaaaacttactcattgcttcaccagtggcctgcattgtacccactaattgcattggaacttcttgattcaaaatttgctgatcaggaagtaagatccctagctgtgacctggattgaggccattagtgatgatgagctaacagatcttcttccacagtttgtacaagctttgaaatatgaaatttacttgaatagttcattagtgcaattccttttgtccagggcattgggaaatatccagatagcacacaatttatattggcttctcaaagatgccctgcatgatgtacagtttagtacccgatacgaacatgttttgggtgctctcctgtcagtaggaggaaaacgacttagagaagaacttctaaaacagacgaaacttgtacagcttttaggaggagtagcagaaaaagtaaggcaggctagtggatcagccagacaggttgttctccaaagaagtatggaacgagtacagtccttttttcagaaaaataaatgccgtctccctctcaagccaagtctagtggcaaaagaattaaatattaagtcgtgttccttcttcagttctaatgctgtccccctaaaagtcacaatggtgaatgctgaccctatgggagaagaaattaatgtcatgtttaaggttggtgaagatcttcggcaagatatgttagctttacagatgataaagattatggataagatctggcttaaagaaggactagatctgaggatggtaattttcaaatgtctctcaactggcagagatcgaggcatggtggagctggttcctgcttccgataccctcaggaaaatccaagtggaatatggtgtgacaggatcctttaaagataaaccacttgcagagtggctaaggaaatacaatccctctgaagaagaatatgaaaaggcttcagagaactttatctattcctgtgctggatgctgtgtagccacctatgttttaggcatctgtgatcgacacaatgacaatataatgcttcgaagcacgggacacatgtttcacattgactttggaaagtttttgggacatgcacagatgtttggcagcttcaaaagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactgatgattccttcagggttaccagaacttacaagtattcaagatttgaaatacgttagagatgcacttcaaccccaaactacagacgcagaagctacaattttctttactaggcttattgaatcaagtttgggaagcattgccacaaagtttaacttcttcattcacaaccttgctcagcttcgtttttctggtcttccttctaatgatgagcccatcctttcattttcacctaaaacatactcctttagacaagatggtcgaatcaaggaagtctctgtttttacatatcataagaaatacaacccagataaacattatatttatgtagtccgaattttgagggaaggacagattgaaccatcatttgtcttccgaacatttgacgaatttcaggaacttcacaataagctcagtattatttttccactttggaagttaccaggctttcctaataggatggttctaggaagaacacacataaaagatgtagcagccaaaaggaaaattgagttaaacagttacttacagagtttgatgaatgcttcaacggatgtagcagagtgtgatcttgtttgtactttcttccaccctttacttcgtgatgagaaagctgaagggatagctaggtctgcagatgcaggttccttcagtcctactccaggccaaataggaggagctgtgaaattatccatctcttaccgaaatggtactcttttcatcatggtgatgcatatcaaagatcttgttactgaagatggagctgacccaaatccatatgtcaaaacatacctacttccagataaccacaaaacatccaaacgtaaaaccaaaatttcacgaaaaacgaggaatccgacattcaatgaaatgcttgtatacagtggatatagcaaagaaaccctaagacagcgagaacttcaactaagtgtactcagtgcagaatctctgcgggagaattttttcttgggtggagtaaccctgcctttgaaagatttcaacttgagcaaagagacggttaaatggtatcagctgactgcggcaacatacttgtaaactagtgaatgtctgagctttggaagcatgaacagttataaacgtgcatgcatacatgcacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagtaaaggaaaaatgcaggatgttaccgtaaaatccagctgctattcatggagctgaaaaacaaagcacaaataatagatagctaagttaagaactactaagtagtttatagaagtagggaaaaacgtaatactgctttttattcatgtctttaaagcctttttcagaataagtgccaatcactgatgttgtaaataatggtgccttaactttatatgcttccctggcacttcgtttctgatttttttcctgatttgataaataattagtacatagttttcactcacttgcagcttactaaagacaagaaattatgtacatgtactaatgtttttcccacaaaaaaatcctttacttctgatgtatgaattagttatctaaatagttaagcctaatacctgaataagactcaccaatgtgattgtacaataaattctatcattccattaaaatcctacatttattcccaggaatggtaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaaaagttattttcctttatataattggattcagaatcataagggacaggactgaaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaatcccagctacttggggggctgaggcaggagaatcgcttgaacccaggaggcggaggttgcagtgagccgagatcacgccactgcactcccgcctgggtgacaagagcaaaactccatcttaaaaaaaaagaaaaaaagagtaagattcatttttattagttactcaacttcagacacaattttgttaatttggatatatacatatatataataagaactcatggttagaatagaaatacagatactttaaaaatggtaatagaaattgtaccaatcaggttgctgtgagaaaactgacaaaatatgcaataaagaataccaagagagaaaggacaatcgccaattcagtttcccagaacagaatttttatgaactgcacaaatgtttaatgtaaatggtgatacctacagggaagaaatagaagagttgataatatatcactgggacggggtgggggaaagacttgaaatttttggtgcctaacactaatggtccatatgtagttaaacccatgagtatggtatatgaatgtcttttttaaatgttaaaatgtgttgtctatttaataagttaattaaaatgcagatcaaagcaccaccatttgctttttccacagatcattaacatttccttaaagtatgtaagtacctttgcaaatgcaaatgtactagtaattttcacttaagcttttgagaccgaattccattccaccagttatcacttagccactgtaatttaaaaacaaacaaacaaacaaaaactgtcttggtagaggtcgttaattagactcaacatgtactgcctttttgcagtctattatgacagtgtcttttagcacaaataatagagctaaaaaatgtcctgtcacttccattataagaaatctggattcatatctaagtgtatattataatactgtacagttaagagttcagaacaagtggtaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctataagaaccaaatactttaattatattaagatagtgaataaagatgtataatatttttattaataccttgaatatattcagtggattgaatgtgacttcataactgtactacgattgtattaaaatatttctggaataaaa

SEQ ID NO: 306532 - DNA, 5499 bp, Homo sapiens
  misc_feature (63)..(64): n is a, c, g, or t
cccgcatctgctcccatcagcagaacacaaggtctgtgatatcttttccttcttctaaatcanngggatgtgagacctccattcttctgtttatggtactatgtaattaattagccatggaagtattcacaaaaactaaaaattttattagcaatgatcaaatcttacttttaaaatgaaaccgactaaaaagctaatttaagacagtgagaccagctgaggcatggtcggctcacctgaggtcaggagttcgagaccagcctggccaacacggcgaaaccccgtctctactaaacatacaaatattagccaggcgtggtggcaagacacctgtggtcccagctactggggaggctgaggcaggaggatcacttgagcccaggagttagaggtggtgggaagctatggttgcatcactgcattccagcctgggtaacaaagcaagacgctgtctctaacagaaataaaaataaaaaataaatctaaaaacaagacacaaaggaagaagtgagaaggggaaatgcgtaggacgaaaaaaaaattctaaatccattttcatttatctttctaatgcttaacatgtggtatttgcagtcgtgttccttcttcagttctaatgctgtccccctaaaagtcacaatggtgaatgctgaccctatgggagaagaaattaatgtcatgtttaaggttggtgaagatcttcggcaagatatgttagctttacagatgataaagattatggataagatctggcttaaagaaggactagatctgaggatggtaattttcaaatgtctctcaactggcagagatcgaggcatggtggagctggttcctgcttccgataccctcaggaaaatccaagtggaatatggtgtgacaggatcctttaaagataaaccacttgcagagtggctaaggaaatacaatccctctgaagaagaatatgaaaaggcttcagagaactttatctattcctgtgctggatgctgtgtagccacctatgttttaggcatctgtgatcgacacaatgacaatataatgcttcgaagcacgggacacatgtttcacattgactttggaaagtttttgggacatgcacagatgtttggcagcttcaaaagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactgatgattccttcagggttaccagaacttacaagtattcaagatttgaaatacgttagagatgcacttcaaccccaaactacagacgcagaagctacaattttctttactaggcttattgaatcaagtttgggaagcattgccacaaagtttaacttcttcattcacaaccttgctcagcttcgtttttctggtcttccttctaatgatgagcccatcctttcattttcacctaaaacatactcctttagacaagatggtcgaatcaaggaagtctctgtttttacatatcataagaaatacaacccagataaacattatatttatgtagtccgaattttgagggaaggacagattgaaccatcatttgtcttccgaacatttgacgaatttcaggaacttcacaataagctcagtattatttttccactttggaagttaccaggctttcctaataggatggttctaggaagaacacacataaaagatgtagcagccaaaaggaaaattgagttaaacagttacttacagagtttgatgaatgcttcaacggatgtagcagagtgtgatcttgtttgtactttcttccaccctttacttcgtgatgagaaagctgaagggatagctaggtctgcagatgcaggttccttcagtcctactccaggccaaataggaggagctgtgaaattatccatctcttaccgaaatggtactcttttcatcatggtgatgcatatcaaagatcttgttactgaagatggagctgacccaaatccatatgtcaaaacatacctacttccagataaccacaaaacatccaaacgtaaaaccaaaatttcacgaaaaacgaggaatccgacattcaatgaaatgcttgtatacagtggatatagcaaagaaaccctaagacagcgagaacttcaactaagtgtactcagtgcagaatctctgcgggagaattttttcttgggtggagtaaccctgcctttgaaagatttcaacttgagcaaagagacggttaaatggtatcagctgactgcggcaacatacttgtaaactagtgaatgtctgagctttggaagcatgaacagttataaacgtgcatgcatacatgcacacacacacagacacacacacacacacttgttaattttgtatagtatttttatacttggacagaacttataaagttaaatatacttgctgcatttcaacacatctgttggaccaacagtcacataactaacctttttgaatttttggaagccattgctgttttaaagtcattatgtagaatgctacaaaccctaaacttaatatatactaattcctgaaaaagactttgagacagtactatgtcagttcagccacctattttgcattgttttctataaggaggcaaagcatatgtgttttcctgttatgcaccttttatagcctttaccactgtgtaatgttcacaaacaccaaagtaaaggaaaaatgcaggatgttaccgtaaaatccagctgctattcatggagctgaaaaacaaagcacaaataatagatagctaagttaagaactactaagtagtttatagaagtagggaaaaacgtaatactgctttttattcatgtctttaaagcctttttcagaataagtgccaatcactgatgttgtaaataatggtgccttaactttatatgcttccctggcacttcgtttctgatttttttcctgatttgataaataattagtacatagttttcactcacttgcagcttactaaagacaagaaattatgtacatgtactaatgtttttcccacaaaaaaatcctttacttctgatgtatgaattagttatctaaatagttaagcctaatacctgaataagactcaccaatgtgattgtacaataaattctatcattccattaaaatcctacatttattcccaggaatggtaatttcacctccctacatctatactccactccctcagtaaataagtgaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtgtgtaaacattttacattcacatgaaaagttattttcctttatataattggattcagaatcataagggacaggactgaaattattctacagtaaccagtaagaataagattcggccgggcacggtggctcctgcctgtaatcccaacactttgggaggccaaggtgggcggatcacctgaggtcaggagtttgagaccagcctggccaacatggtgaaaccccgtctctacacaaaaattagccaggcgtggtagcgggcatctgtaatcccagctacttggggggctgaggcaggagaatcgcttgaacccaggaggcggaggttgcagtgagccgagatcacgccactgcactcccgcctgggtgacaagagcaaaactccatcttaaaaaaaaagaaaaaaagagtaagattcatttttattagttactcaacttcagacacaattttgttaatttggatatatacatatatataataagaactcatggttagaatagaaatacagatactttaaaaatggtaatagaaattgtaccaatcaggttgctgtgagaaaactgacaaaatatgcaataaagaataccaagagagaaaggacaatcgccaattcagtttcccagaacagaatttttatgaactgcacaaatgtttaatgtaaatggtgatacctacagggaagaaatagaagagttgataatatatcactgggacggggtgggggaaagacttgaaatttttggtgcctaacactaatggtccatatgtagttaaacccatgagtatggtatatgaatgtcttttttaaatgttaaaatgtgttgtctatttaataagttaattaaaatgcagatcaaagcaccaccatttgctttttccacagatcattaacatttccttaaagtatgtaagtacctttgcaaatgcaaatgtactagtaattttcacttaagcttttgagaccgaattccattccaccagttatcacttagccactgtaatttaaaaacaaacaaacaaacaaaaactgtcttggtagaggtcgttaattagactcaacatgtactgcctttttgcagtctattatgacagtgtcttttagcacaaataatagagctaaaaaatgtcctgtcacttccattataagaaatctggattcatatctaagtgtatattataatactgtacagttaagagttcagaacaagtggtaatgttttctcttaatttaactcattttgtgccttctttactcattcaaacacacatacattttacatatagtttatttctttatgaaatgctaatcttcagcccgtaccaaaaagtagagtggagcctctttgcactactactatcaataaattttaaatcagttggatttttaagcattttttaaaagctgacattaaagtaaatctaaaaaaagtttaacaaactggccaagacactaatttttatgtataatcacaatattttatactcacctttattgactaaaaataattatgctacatgttgtcctgcatcagaagaattatttcttcttgccagtgttttgggatttgaagataatggttcactcaaagaacctattattttctctactgaggaacccaatgtagaacttgcactgatatttttattactgcctttatatgaatctataggtatctaaatgttaaggcatgtatgatctttgatcatttcttttttcaaattaaagttgtataaaagtttcaatatcttgccttaaattagttgcctattctttctaggattcaaatattgtgacatttaaaaaagaaaacattcacttttgaaacttagacttcagatcaaaaaggactgaacccccactatcataatccatacattcatttccatgttgtttgactagcagtgcatatatgaatgaatatggtaattaatcttacctataagaaccaaatactttaattatattaagatagtgaataaagatgtataatatttttattaataccttgaatatattcagtggattgaatgtgacttcataactgtactacgattgtattaaaatatttctggaataaaa

SEQ ID NO: 306533 - DNA, 4381 bp, Homo sapiens
  misc_feature (4368)..(4368): n is a, c, g, or t
cgtgctgcgcttggctggctgtggagtcggccgaagctttcggcggcggctgagccagctgaggggaaaaatggctcggactgtggcggcttcggcggctcaggttgtggtagaggcggaggctcaggcagcttgaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcgcaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaataatcattgccttggaagtcatgagcatattcaaaactgtcgaaaatgggacacagaaattagactacaactcttgaccttcagtgcaatgtgtcaaaatctggcccgaacagcagaagatgatgaaacacccgtggatttaaacaaacacctgtatcaaatagaaaaaccttgcaaagaagccatgacgagacaccctgttgaagaactcttagattcttatcacaaccaagtagaactggctcttcaaattgaaaaccaacaccgagcagtagatcaagtaattaaagctgtaagaaaaatctgtagtgctttagatggtgtcgagactcttgccattacagaatcagtaaagaagctaaagagagcagttaatcttccaaggagtaaaactgctgatgtgacttctttgtttggaggagaagacactagcaggagttcaactaggggctcacttaatcctgaaaatcctgttcaagtaagcataaaccaattaactgcagcaatttatgatcttctcagactccatgcaaattctggtaggagtcctacagactgtgcccaaagtagcaagagtgtcaaggaagcatggactacaacagagcagctccagtttactatttttgctgctcatggaatttcaagtaattgggtatcaaattatgaaaaatactacttgatatgttcactgtctcacaatggaaaggatctttttaaacctattcaatcaaagaaggttggcacttacaagaatttcttctatcttattaaatgggatgaactaatcatttttcctatccagatatcacaattgccattagaatcagttcttcaccttactctttttggaattttaaatcagagcagtggaagttcccctgattctaataagcagagaaagggaccagaagctttgggcaaagtttctttacctctttgtgactttagacggtttttaacatgtggaactaaacttctatatctttggacttcatcacatacaaattctgttcctggaacagttaccaaaaaaggatatgtcatggaaagaatagtgctacaggttgattttccttctcctgcatttgatattatttatacaactcctcaagttgacagaagcattatacagcaacataacttagaaacactagagaatgatataaaagggaaacttcttgatattcttcataaagactcatcacttggactttctaaagaagataaagcttttttatgggagaaacgttattattgcttcaaacacccaaattgtcttcctaaaatattagcaagcgccccaaactggaaatggggtaatcttgccaaaacttactcattgcttcaccagtggcctgcattgtacccactaattgcattggaacttcttgattcaaaatttgctgatcaggaagtaagatccctagctgtgacctggattgaggccattagtgatgatgagctaacagatcttcttccacagtttgtacaagctttgaaatatgaaatttacttgaatagttcattagtgcaattccttttgtccagggcattgggaaatatccagatagcacacaatttatattggcttctcaaagatgccctgcatgatgtacagtttagtacccgatacgaacatgttttgggtgctctcctgtcagtaggaggaaaacgacttagagaagaacttctaaaacagacgaaacttgtacagcttttaggaggagtagcagaaaaagtaaggcaggctagtggatcagccagacaggttgttctccaaagaagtatggaacgagtacagtccttttttcagaaaaataaatgccgtctccctctcaagccaagtctagtggcaaaagaattaaatattaagtcgtgttccttcttcagttctaatgctgtccccctaaaagtcacaatggtgaatgctgaccctatgggagaagaaattaatgtcatgtttaaggttggtgaagatcttcggcaagatatgttagctttacagatgataaagattatggataagatctggcttaaagaaggactagatctgaggatggtaattttcaaatgtctctcaactggcagagatcgaggcatggtggagctggttcctgcttccgataccctcaggaaaatccaagtggaatatggtgtgacaggatcctttaaagataaaccacttgcagagtggctaaggaaatacaatccctctgaagaagaatatgaaaaggcttcagagaactttatctattcctgtgctggatgctgtgtagccacctatgttttaggcatctgtgatcgacacaatgacaatataatgcttcgaagcacgggacacatgtttcacattgactttggaaagtttttgggacatgcacagatgtttggcagcttcaaaagggatcgggctccttttgtgctgacctctgatatggcatatgtcattaatgggggtgaaaagcccaccattcgttttcagttgtttgtggacctctgctgtcaggcctacaacttgataagaaagcagacaaacctttttcttaacctcctttcactgatgattccttcagggttaccagaacttacaagtattcaagatttgaaatacgttagagatgcacttcaaccccaaactacagacgcagaagctacaattttctttactaggcttattgaatcaagtttgggaagcattgccacaaagttccgttgaanccgtcgggtaccg

SEQ ID NO: 306534 - DNA, 1729 bp, Homo sapiens
cgtgctgcgcttggctggctgtggagtcggccgaagctttcggcggcggctgagccagctgaggggaaaaatggctcggactgtggcggcttcggcggctcaggttgtggtagaggcggaggctcaggcagcttgaggccttgctattttggaagctacaagaaaaaaatagaggaaggaaggtttggtctttttagtggacatggctcagatatctagcaacagcggatttaaagaatgtccatcttcacatccggaaccaacaagagcaaaagatgtggacaaagaagaagcattacagatggaagcagaggctttagcaaaactgcaaaaggatagacaagtgactgacaatcagagaggctttgagttgtcaagcagcaccagaaaaaaagcacaggtttataacaagcaggattatgatctcatggtgtttcctgaatcagattcccaaaaaagagcattagatattgatgtagaaaagctcacccaagctgaacttgagaaactattgctggatgacagtttcgagactaaaaaaacacctgtattaccagttactcctattctgagcccttccttttcagcacagctctattttagacctactattcagagaggacagtggccacctggattacctgggccttccacttatgctttaccttctatttatccttctacttacagtaaacaggctgcattccaaaatggcttcaatccaagaatgcccacttttccatctacagaacctatatatttaagtcttccgggacaatctccatatttctcatatcctttgacacctgccacaccctttcatccacaaggaagcttacctatctatcgtccagtagtcagtactgacatggcaaaactatttgacaaaatagctagtacatcagaatttttaaaaaatgggaaagcaaggactgatttggagataacagattcaaaagtcagcaatctacaggtatctccaaagtctgaggatatcagtaaatttgactggttagacttggatcctctaagtaagcctaaggtggataatgtggaggtattagaccatgaggaagagaaaaatgtttcaagtttgctagcaaaggatccttgggatgctgttcttcttgaagagagatcgacagcaaattgtcatcttgaaagaaaggtgaatggaaaatccctttctgtggcaactgttacaagaagccagtctttaaatattcgaacaactcagcttgcaaaagcccagggccatatatctcagaaagacccaaatgggaccagtagtttgccaactggaagttctcttcttcaagaagttgaagtacagaatgaggagatggcagctttttgtcgatccattacaaaattgaagaccaaatttccatataccaatcaccgcacaaacccaggctatttgttaagtccagtcacagcgcaaagaaacatatgcggagaaaatgctagtgtgaaggtctccattgacattgaaggatttcagctaccagttacttttacgtgtgatgtgagttctactgtagaaatcattataatgcaagccctttgctgggtacatgatgacttgaatcaagtagatgttggcagctatgttctaaaagtttgtggtcaagaggaagtgctgcagaagtaagtttatttaactactgagcaacatccttggaaatttcatttttaatggtttaatctagaaaaatttcaagttaaa

SEQ ID NO: 306535 - DNA, 632 bp, Homo sapiens
tcaggtttatttgtacaaatagcacaggaggtgaggacccagccccatgcagacggcagcctgggcaggttgcaccagtccttgtgtcctcacgttggcaggcagatacctactctgaagcctttgtaggagcctgagcacctttgcgaacctgagctggaactgaagctggagttgcagcctgggccttggtttgatccttgtccttgtcgtttggccggcacaacccaagccccttggcaatgcgggcacaagcacgcttcccaagcttggggtgggcaatgtaggcaagtcgatggagcttgctgctgacaccctttgggatcttgggcttaacctcctttacaagggccttcatagcctcaccacgtggactgatggcctgccaaagcctgcatcttctttaggcccttcttgttttgcttcttggcaatgcacatgttcctcaggaatttggggtccaccccattgagagagtcatatctttgtgatcggggtatcttttctctttcttttgtctgatctttgcttttgttttcttttcttttctcttttcttttcttttctttttttgagacagagtctcgctctgttgccaggctggagcgcagtggtgcgatctcggctcactg

SEQ ID NO: 306536 - DNA, 415 bp, Homo sapiens
atcattagaaaaaataatgcagaaatttaaatgacctccatctgttttctaccccatatgcatttggctatcagccatctttagtgtttttagctctctattctctatatatagaacagaagtagtttttgttccaaaagctatttatatatctgaaagtaggcttgaaagcatttatgttttccatttaacaaacaagttttttttcaggatgttgactcactttttttctgagtcagttacaaataatatttaattctgatagaattttattttcagttctcagaaaaacactttagttgcaagattttatcatacacttaactatatttaatttgacaatagaaagaccaaagagtggatgtgatttttttgtgtatatgtgtttgtttaggcagaagatgatgaaacaccc

SEQ ID NO: 306537 - DNA, 169 bp, Homo sapiens
tgtgctgctatgtagcattttgtggatcttccacttttaaaataaaaacacttttttaattacagaaagacccaaatgggaccagtagtttgccaactggaagttctcttcttcaagaagttgaagtacagaatgaggagatggcagctttttgtcgatccattacaaa

SEQ ID NO: 306538 - DNA, 845 bp, Homo sapiens
gtgaaatagctgagtcaagagcgacatgtatttttagttataatagttgttacattgctctacaaaagaagctacacctgtgtacacctctctccctaccaataagttatgaaatcgtttcctaacacaggatgttgttttaaattttcatctgataggtgaaaaactgcattcatttttgtttggcttctatttctttgactattagtgagctttaacattttcgtatacattggttggccaaatgtacctttgcccactatatttatagcctttggccattctagttttatagtaaaaattaactctctttagtaacaacctttttttcaccgtttgacaactgggcattttataaattgtatccacagcataacttgtctgaaaaatagatcttcattttcattatgtacttacagtatcacatctctttctataggttgttctccaaagaagtatggaacgagtacagtccttttttcagaaaaataaatgccgtctccctctcaagccaagtctagtggcaaaagaattaaatattaaggtgacacataaaatacttataagttcatattacatttgaaaataataggaagaaggcaaatgggcaggtatgcttaaggcaaatgaaggtaaaacctgcacaggttggttataagcatggatggttgtgattaggatccatatttatcttagcatatttttttacctaaccaccattcctgggaaaaaaaaagtataaaattatttactgccttgggcttcatttttttaaattggtctcacctttttatttatttatttatttatttatttatttatttatttatttatttatttatttt

SEQ ID NO: 306539 - DNA, 384 bp, Homo sapiens
tttccaaatgagaataagaaaaaaatagctctagttttagtgatttgctactaatttatgcttctacttctgattctaatgtaaaattaatagcaatttgcatatgaataattgtgtcagacgaagtgaaaattaacccggccttgccttttcctactttgaaataaactatacaattgaaaagctatgttttttctttgtcatcacaaaagagtagaggatatctgttagggatatctaagatatctagtttctgacttcgtctctggaattggtcctttaaatttcacctacctatttttattttattttttatttttaaagaaccaacaccgagcagtagatcaagtaattaaagctgtaagaaaaatctgtagtgcttta

SEQ ID NO: 306540 - DNA, 476 bp, Homo sapiens
ggatatggtcacctgggctgggagatggaaaaggaatgagggggtttgaggaggaagaggatgctcaagttgagtcttaaatgattaattccttctattcataagggcaggatggataaacgtgatcaggttctaggccctgctctgcttctatcaagcggtgagatattgagcaaactgcttaatacttctggtatccattttccttattcaggattcgactacatatataaagcagtgctgtacatgagaaatatgtgagccaaaaatgggagtcacataggtaggagattttacattatttttttcccctaaatcttttaaatctggtgtatgttacacttggtacatctcaatttggaacagccacatttcaggcacttaatagctccatgtaactagtaactgccatattggacagtatagatctagaggctgggtgcattaatgcatgcccatagtccagtgctttggag

SEQ ID NO: 306541 - DNA, 257 bp, Homo sapiens
gaaatggtactcttttcatcatggtgatgcatatcaaagatcttgtgagtgattacaaagaatgatggttgtagaggaaacccttaccttggtaggaagcattactattaagggactgcttttctttttaggttactgaagatggagctgacccaaatccatatgtcaaaacatacctacttccagataaccacaaaacatccaaacgtaaaaccaaaatttcacgaaaaacgaggaatccgacattcaatgaaatg

SEQ ID NO: 306542 - DNA, 2998 bp, Homo sapiens
gctataaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 306543 - DNA, 807 bp, Homo sapiens
gctataaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactgtgagtaactgagcccggagggctggactaggcagacccggtgggagagacgtgcaggggcacctgcagaggcctgggggaatctttgccacttgctcgtagggtcaaggaggggctccttgcagggcaggtggggacatccttggaaagtccctttgtgaatttctttgggtacaattaaagtatttacaggctgggtgcggtggctcatgcctgtaatcccagcactttgggaggctgagggaggcggatcacttgaggtcaggagttcgagaccagcctgaccaccatggagaaaccccgtctctattaaaaatacaaaaaaaactagccaggcatagtggcacatacctgtaatcccagctactcgggaggctgaggcaggagaatctcttgaaactggga

SEQ ID NO: 306544 - DNA, 3105 bp, Homo sapiens
gctataaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgccaaaaaaaaaacacaataccacaagcaacaacgatactaacataaaaaaaaaaagggggggcgcccaaaaattccccgggggggcaccaataaaggaccccgtttttg

SEQ ID NO: 306545 - DNA, 3209 bp, Homo sapiens
gctataaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgccaaaaaaaaaaaaaaaaaaaaaaaaaaaaaaaaaaaaaaaaaaaaaaaaaaaaaaaacaaacaaactaatcacttttccattctccccctcgcccctcctccttaacgttccttcctctacaccaccgtcccaatcaacacttcccctgccttctcctcctccctcccctcaccttttcctttccgacccttcttgttcccactctcccccc

SEQ ID NO: 306546 - DNA, 2976 bp, Homo sapiens
gctataaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccactcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 306547 - DNA, 2824 bp, Homo sapiens
gctataaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcaccactgcactctaacctatgtgacagagcgagacccctcaa

SEQ ID NO: 306548 - DNA, 2979 bp, Homo sapiens
gctataaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 306549 - DNA, 3186 bp, Homo sapiens
caaatagctaggactacaggcacgtcccaccatgcccagctaatttttgtatttttggtggagacggggctttgtcatgttggccaggctgatctcaaattcctgacctcaagtgatctgcccgccttggcctcccaaagtgctgggattacaggcgtgagccaccacacccggcctgctcatgaattttctctttaacttccacatcgaaggcaaagtattgtcttgttaaggctgtgcctccagcacccagcacaggctgggcgcacattcccttgatgaacctgatttgtaatgcctgtcgcctcttccctcgtttcttctaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 306550 - DNA, 2964 bp, Homo sapiens
agatagtatagtcgagctggtgtaattcaggcagaggctggctcgtatagtacaggacccgcggcaggctgaccgactctggtctgctcgggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 306551 - DNA, 2841 bp, Homo sapiens
gctataaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 306552 - DNA, 1383 bp, Homo sapiens
  misc_feature (8)..(8): n is a, c, g, or t
  misc_feature (17)..(17): n is a, c, g, or t
gctgttcnagaggatcngacacttgaaacgtaagacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 306553 - DNA, 631 bp, Homo sapiens
gagatgctaggggtaggattagcttgaatctttattcttacattttctcctgtctgctccctgcttagccctcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 306554 - DNA, 315 bp, Homo sapiens
tgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgt

SEQ ID NO: 306555 - DNA, 1266 bp, Homo sapiens
gagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggtt

SEQ ID NO: 306556 - DNA, 1176 bp, Homo sapiens
accataacgggcctaggtacgaggctggatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggtt

SEQ ID NO: 306557 - DNA, 1375 bp, Homo sapiens
gagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggcagaatttcctcttgggccagggccccttttccttgaaccccaaattaaaattcctttgacggacgggttaccccaacaggagacctcaataaacaaacaaataaaagggaacaaaaagtgaatagcacaagggcgggggggcgaaaataaaataatccg

SEQ ID NO: 306558 - DNA, 1151 bp, Homo sapiens
gagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgagaactcagggagaaactcaggagtgcagtaccagggacacctcaggacagattctctggccaggcccttccctgacccaataaatcctgaagaggtt

SEQ ID NO: 306559 - DNA, 1219 bp, Homo sapiens
accttcgtgctatggtatgaggcctggtgtgtgtgacttccgtgtccttcgtcgcggccgtgtttctgtgcgggtcccggctcggggttagaaccgctgtgtgccaggggttcggtctatctgtgaggtgcgacgccacgttacccggcgtgtttgtgcgccagcgggtgccgctgcgcggtgtgaagaacgtcagtgctccatgagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggtt

SEQ ID NO: 306560 - DNA, 1090 bp, Homo sapiens
gagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttgagtgcagtaccagggacacctcaggacagattctctggccaggcccttccctgacccaataaatcctgaagaggtt

SEQ ID NO: 306561 - DNA, 1064 bp, Homo sapiens
gagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttacagattctctggccaggcccttccctgacccaataaatcctgaagaggtt

SEQ ID NO: 306562 - DNA, 1197 bp, Homo sapiens
gagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggtt

SEQ ID NO: 306563 - DNA, 1604 bp, Homo sapiens
tcagtggcgctgccctcgatcactctgcccctctgggtgcctgtcacctcattagtgcagttactcctgggaccaagaccaggaaatctaaccaataagcaatggtaacagtgactcagtgctcagtccgccctcagtggcccgagtccgaggtgggcatcatggcaccagtttacatctcggaaagggaggctcagagaggtcaagtcacttgcctaaggtcacccagggactgcttagctggctaggatgagaaccagcctgctccaacgccccctcgtggaacagttgcgagcctaggaattaaatgttccctcccccaggctatgccaatgaggtgggcgaggctttccgctctcttgtgccagcggcggtggtgtggctgagctatggcgtggccagctcctacgtgctggcggatgccattgacaaaggcaagaaggctggagaggtgagtgttagcctattttccaacccccaaccctagctctcttcttgtgtggttcagtccacagccttgcatgtgataaagtccctgtgggacactccagtccctacaaccttgcctagtgcagtccatagacagtcctgtttgtaggacagtgtacccctgcccccacactcccactccccgaactggatgtggcagactgtaccccactcctgggtgcggacaagtccactggccacttgcccctcccggtctagcctcgtgccccttgtcgcaggattttctgcctctgccccagctggattaagtgtctctgcgcccaccagggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatccccatcattatccaccccattgacaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggtt

SEQ ID NO: 306564 - DNA, 1033 bp, Homo sapiens
gagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtcggtggatttcctcctggactccagcctgcgcaagctctacccaacagtggggaagcccagctcctcctgatcatactctggtacctggcctgtgcatcggcctcctgcttcatgtcaacctcctactcctgccagggaatgtggacacctggctccctggtgtccaaagaccctggcacctgggtgggtttgagctggacagaagcttagagacaaaggcttcaagaagcagtggctgcagggagtcacagaagggcaggacctgaacgctgtctgcttccctggaatccaagatgctgagtggaagtggaccctgggtgggcccggccctgtctttttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggtt

SEQ ID NO: 306565 - DNA, 1031 bp, Homo sapiens
tcagtggcgctgccctcgatcactctgcccctctgggtgcctgtcacctcattagtgcagttactcctgggaccaagaccaggaaatctaaccaataagcaatggtaacagtgactcagtgctcagtccgccctcagtggcccgagtccgaggtgggcatcatggcaccagtttacatctcggaaagggaggctcagagaggtcaagtcacttgcctaaggtcacccagggactgcttagctggctaggatgagaaccagcctgctccaacgccccctcgtggaacagttgcgagcctaggaattaaatgttccctcccccaggctatgccaatgaggtgggcgaggctttccgctctcttgtgccagcggcggtggtgtggctgagctatggcgtggccagctcctacgtgctggcggatgccattgacaaaggcaagaaggctggagaggtgagtgttagcctattttccaacccccaaccctagctctcttcttgtgtggttcagtccacagccttgcatgtgataaagtccctgtgggacactccagtccctacaaccttgcctagtgcagtccatagacagtcctgtttgtaggacagtgtacccctgcccccacactcccactccccgaactggatgtggcagactgtaccccactcctgggtgcggacaagtccactggccacttgcccctcccggtctagcctcgtgccccttgtcgcaggattttctgcctctgccccagctggattaagtgtctctgcgcccaccaggttcaggaaaattacatcctcccatggaggatgagagactgaggctcagggagggcaaggaataggcccaagatcacttggcaagctgggcacccaggacccccaggtgcttgacagagtcaccccatggtggtatggctgaacaaggagcggcagacaactcagggagaaactcaggagtgcagtaccagggacacctcaggacagattctctggccaggcccttccctgacccaataaatcctgaagaggtt

SEQ ID NO: 306566 - DNA, 844 bp, Homo sapiens
gagcgattagcgccaacagctcagagaaaacgtgacgaaaaccagtctgtaaaacccgagcctgggagaggggcttcggtgcgcggggggaatttgcagacgctccctgctggcggagatttcctgacctgtccttcggcgcgggactttcggcgggtcccggccgggcagacccaagtgccggcggcggagactgcagtggagccagtaccggctgtagtggccggggccgtggcgggagagtcatgtcagagccgcagccgcggggcgcagagcgcgatctctaccgggacacgtgggtgcgatacctgggctatgccaatgaggtgggcgaggctttccgctctcttgtgccagcggcggtggtgtggctgagctatggcgtggccagctcctacgtgctggcggatgccattgacaaaggcaagaaggctggagaggtgcccagccctgaagcaggccgcagcgccagggtgactgtggctgtggtggacacctttgtatggcaggctctagcctctgtggccattccgggcttcaccatcaaccgcgtgtgtgctgcctctctctatgtcctgggcactgccacccgctggcccctggctgtccgcaagtggaccaccaccgcgcttgggctgttgaccatcccctcccgtgggaagtgacttcccacgggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactaca

SEQ ID NO: 306567 - DNA, 482 bp, Homo sapiens
ctgacattctccttaatggagaaagatggagtgttttcctcttaagatccggaacaaggcaagcatgtttgcttttgtttttgccacttttatataacattgtacttgatattctagccagggcaatcactcaagaaaaataaggggtatccagattagaaagtaggaagtaaaaatacctctatttgtcaatgacgtgatatcttgtatacagaaaatcctaaggaatcctccgaaaaacagaactaagcaagttcagcaatgtggcaggatataaaattgatatcctggctaacacggtgaaaccccgtctctactaaaaatacaaaaaattagctgggtgtggtggcaggtgcttgtagtcccagctactcaggaggctgaggcaggagaacggcgtgaacccgggaggcagagcttgcagtgagctgagattgcaccactgcactccagcctgggcaacagagcgagactccatctca

SEQ ID NO: 306568 - DNA, 3586 bp, Homo sapiens
tcttgcgaagtttttcttgattccgccaatccacacagtttcctttataaaatggaaaagcatgaactaaaaaacccagaaatagctatctggcttagatttacaggataaaatctccatgtctgtaaaaactttaaggcagaaatttgggatttatggtacaaaccctttaagggactgtgagtcagtaatacccacagcactcaacattgtgagtttccacacatccctggacttgagtgagtctttccaagtgtttgttaatggtacaaatgatgacaaaattagtggttcaaaaatattaaagtgcacatgctttttgctttctctatgtatacagagattacatatatgtatactttctagcgtctagcaagtatggtatggctagggataattatgtttttctgattattttgtttcccatcaaacaccccacgaattttacagcagaccgccttcttgtcaccatttgaaagaatgtggtcagaaaagtaatgcaaaaactgccactttggttttgtctgtaccttccaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacagatggagtctcactctgttgcccagactggaatgcagtggtgtgatctcaactgactgcaacctccgtatcctgggttcaagcaactctcctgctgcagccacgaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttgggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactaaagtctaggcaagtggctgagctaggtttgccatgaatcaatctgctgagtatatttcttggtaactagttcatctttccttaattcagtcaacaaatatgatatcaagtttagtaagatgatgacagatgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattgagggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcaaaaaa

SEQ ID NO: 306569 - DNA, 3140 bp, Homo sapiens
acgctggggcttggcagcagaagggatgggaccagagagaagggtgtggaggagaccccagtgagggccaggacatttcaggtaaagagaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacagatggagtctcactctgttgcccagactggaatgcagtggtgtgatctcaactgactgcaacctccgtatcctgggttcaagcaactctcctgctgcagccacgaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttgggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactaaagtctaggcaagtggctgagctaggtttgccatgaatcaatctgctgagtatatttcttggtaactagttcatctttccttaattcagtcaacaaatatgatatcaagtttagtaagatgatgacagatgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattgagggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcaaaaaa

SEQ ID NO: 306570 - DNA, 3533 bp, Homo sapiens
tcttgcgaagtttttcttgattccgccaatccacacagtttcctttataaaatggaaaagcatgaactaaaaaacccagaaatagctatctggcttagatttacaggataaaatctccatgtctgtaaaaactttaaggcagaaatttgggatttatggtacaaaccctttaagggactgtgagtcagtaatacccacagcactcaacattgtgagtttccacacatccctggacttgagtgagtctttccaagtgtttgttaatggtacaaatgatgacaaaattagtggttcaaaaatattaaagtgcacatgctttttgctttctctatgtatacagagattacatatatgtatactttctagcgtctagcaagtatggtatggctagggataattatgtttttctgattattttgtttcccatcaaacaccccacgaattttacagcagaccgccttcttgtcaccatttgaaagaatgtggtcagaaaagtaatgcaaaaactgccactttggttttgtctgtaccttccaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacagatggagtctcactctgttgcccagactggaatgcagtggtgtgatctcaactgactgcaacctccgtatcctgggttcaagcaactctcctgctgcagccacgaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttgggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactaaagtctaggcaagtggctgagctaggtttgccatgaatcaatctgctgagtatatttcttggtaactagttcatctttccttaattcagtcaacaaatatgatatcaagtttagtaagatgatgacagatgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattgagggaagatgagctaggaatcaagaaatacgcagaactgattcctgtcactggcgccaccctgccacttgcccagagctgtggtataaatttttttaataggctgaaatatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcaaaaaa

SEQ ID NO: 306571 - DNA, 2756 bp, Homo sapiens
tcttgcgaagtttttcttgattccgccaatccacacagtttcctttataaaatggaaaagcatgaactaaaaaacccagaaatagctatctggcttagatttacaggataaaatctccatgtctgtaaaaactttaaggcagaaatttgggatttatggtacaaaccctttaagggactgtgagtcagtaatacccacagcactcaacattgtgagtttccacacatccctggacttgagtgagtctttccaagtgtttgttaatggtacaaatgatgacaaaattagtggttcaaaaatattaaagtgcacatgctttttgctttctctatgtatacagagattacatatatgtatactttctagcgtctagcaagtatggtatggctagggataattatgtttttctgattattttgtttcccatcaaacaccccacgaattttacagcagaccgccttcttgtcaccatttgaaagaatgtggtcagaaaagtaatgcaaaaactgccactttggttttgtctgtaccttccaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacagatggagtctcactctgttgcccagactggaatgcagtggtgtgatctcaactgactgcaacctccgtatcctgggttcaagcaactctcctgctgcagccacgaaaaatgaggaagctgtgagtaccagtggaaggaacgagccaggaagagggactggaaccatctcagaagccatgcccctcaggctggaacttgccctgtctcctcgcagatgagctacctcttgtgtttaagaattgagggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcaaaaaa

SEQ ID NO: 306572 - DNA, 2600 bp, Homo sapiens
tcttgcgaagtttttcttgattccgccaatccacacagtttcctttataaaatggaaaagcatgaactaaaaaacccagaaatagctatctggcttagatttacaggataaaatctccatgtctgtaaaaactttaaggcagaaatttgggatttatggtacaaaccctttaagggactgtgagtcagtaatacccacagcactcaacattgtgagtttccacacatccctggacttgagtgagtctttccaagtgtttgttaatggtacaaatgatgacaaaattagtggttcaaaaatattaaagtgcacatgctttttgctttctctatgtatacagagattacatatatgtatactttctagcgtctagcaagtatggtatggctagggataattatgtttttctgattattttgtttcccatcaaacaccccacgaattttacagcagaccgccttcttgtcaccatttgaaagaatgtggtcagaaaagtaatgcaaaaactgccactttggttttgtctgtaccttccaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacagtggaaccatctcagaagccatgcccctcaggctggaacttgccctgtctcctcgcagatgagctacctcttgtgtttaagaattgagggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcaaaaaa

SEQ ID NO: 306573 - DNA, 3483 bp, Homo sapiens
tcttgcgaagtttttcttgattccgccaatccacacagtttcctttataaaatggaaaagcatgaactaaaaaacccagaaatagctatctggcttagatttacaggataaaatctccatgtctgtaaaaactttaaggcagaaatttgggatttatggtacaaaccctttaagggactgtgagtcagtaatacccacagcactcaacattgtgagtttccacacatccctggacttgagtgagtctttccaagtgtttgttaatggtacaaatgatgacaaaattagtggttcaaaaatattaaagtgcacatgctttttgctttctctatgtatacagagattacatatatgtatactttctagcgtctagcaagtatggtatggctagggataattatgtttttctgattattttgtttcccatcaaacaccccacgaattttacagcagaccgccttcttgtcaccatttgaaagaatgtggtcagaaaagtaatgcaaaaactgccactttggttttgtctgtaccttccaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacagatggagtctcactctgttgcccagactggaatgcagtggtgtgatctcaactgactgcaacctccgtatcctgggttcaagcaactctcctgctgcagccacgaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttgggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactaaagtctaggcaagtggctgagctaggtttgccatgaatcaatctgctgagtatatttcttggtaactagttcatctttccttaattcagtcaacaaatatgatatcaagtttagtaagatgatgacagatgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattgagggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatcta

SEQ ID NO: 306574 - DNA, 2305 bp, Homo sapiens
tcttgcgaagtttttcttgattccgccaatccacacagtttcctttataaaatggaaaagcatgaactaaaaaacccagaaatagctatctggcttagatttacaggataaaatctccatgtctgtaaaaactttaaggcagaaatttgggatttatggtacaaaccctttaagggactgtgagtcagtaatacccacagcactcaacattgtgagtttccacacatccctggacttgagtgagtctttccaagtgtttgttaatggtacaaatgatgacaaaattagtggttcaaaaatattaaagtgcacatgctttttgctttctctatgtatacagagattacatatatgtatactttctagcgtctagcaagtatggtatggctagggataattatgtttttctgattattttgtttcccatcaaacaccccacgaattttacagcagaccgccttcttgtcaccatttgaaagaatgtggtcagaaaagtaatgcaaaaactgccactttggttttgtctgtaccttccaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagtaagtagattcttctgttttactgcttttaaaaaaagtttaaagttttaaaatagtataaactttaattgggttctttaaattttgttgttgaataatgcaattattatgatattttgtgaatatttgtaaataatgggattctggaataaattaatccccgatgatagaaaagagttaatgaacactttctccatacataacactttagcattcaagaaacataggacttaaatacatatattaaaaatttaggccaggtgcagtggctcacgcctgtaatcccagcactttgggaggctgaggcgggcagatcacctgaggtcaggagtttgagaccagcctagccaacatggtgaaatcccatctcggctaaaaatgcaaaaattagccaggcatggtggcaggtgcctgtaatcccagctactctggaggctgaggcaggagaatcacttgaacctgggaggcagaggttgcagtgagctgagactgtgccactgcactccagtctgggcgacagagaggctctgtctcaaaaaaaaaaaaaaaaaaa

SEQ ID NO: 306575 - DNA, 1786 bp, Homo sapiens
gcagcacgcagcctccagtcttgagtgactcctgggctttggctcagcagtaactcctccataaaaacaagtgtgtgcatctggctgttagaagaattcatgctcatccgggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttgggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactaaagtctaggcaagtggctgagctaggtttgccatgaatcaatctgctgagtatatttcttggtaactagttcatctttccttaattcagtcaacaaatatgatatcaagtttagtaagatgatgacagatgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattgagggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcaaaaaa

SEQ ID NO: 306576 - DNA, 2080 bp, Homo sapiens
tcttgcgaagtttttcttgattccgccaatccacacagtttcctttataaaatggaaaagcatgaactaaaaaacccagaaatagctatctggcttagatttacaggataaaatctccatgtctgtaaaaactttaaggcagaaatttgggatttatggtacaaaccctttaagggactgtgagtcagtaatacccacagcactcaacattgtgagtttccacacatccctggacttgagtgagtctttccaagtgtttgttaatggtacaaatgatgacaaaattagtggttcaaaaatattaaagtgcacatgctttttgctttctctatgtatacagagattacatatatgtatactttctagcgtctagcaagtatggtatggctagggataattatgtttttctgattattttgtttcccatcaaacaccccacgaattttacagcagaccgccttcttgtcaccatttgaaagaatgtggtcagaaaagtaatgcaaaaactgccactttggttttgtctgtaccttccaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacagatggagtctcactctgttgcccagactggaatgcagtggtgtgatctcaactgactgcaacctccgtatcctgggttcaagcaactctcctgctgcagccacgaaaaatgaggaagctgtgagtaccagtggaaggaacgagccaggaagagggactggaaccatctcagaagccatgcccctcaggctggaacttgccctgtctcctcgcagatgaggtgcaggtcttctgaacaaatgcctcctgaggatttctgtgcctggaaaatat

SEQ ID NO: 306577 - DNA, 1960 bp, Homo sapiens
tcttgcgaagtttttcttgattccgccaatccacacagtttcctttataaaatggaaaagcatgaactaaaaaacccagaaatagctatctggcttagatttacaggataaaatctccatgtctgtaaaaactttaaggcagaaatttgggatttatggtacaaaccctttaagggactgtgagtcagtaatacccacagcactcaacattgtgagtttccacacatccctggacttgagtgagtctttccaagtgtttgttaatggtacaaatgatgacaaaattagtggttcaaaaatattaaagtgcacatgctttttgctttctctatgtatacagagattacatatatgtatactttctagcgtctagcaagtatggtatggctagggataattatgtttttctgattattttgtttcccatcaaacaccccacgaattttacagcagaccgccttcttgtcaccatttgaaagaatgtggtcagaaaagtaatgcaaaaactgccactttggttttgtctgtaccttccaggtcatatctccgtacctcacttcctgacacaaacaagttttcactgttgtcagcaacaaagccctaatatagctgcggaagagaaaaactgcattgcattttgcctcctgcaagcatcatcaacagttactggaggaacgtaattccagaaagcttgaaagccgtggtgatggtaattatgtatcaaatgcctggttctatttctgttattattgttttgtcatttctgttttcccagcgatctgactgaactcgcagagggacaaatccagtttttctttttgacttttgtcaaactaaatcaggcctgatagaaaactcattgctctccggggaaacaaagtaggagccacgaaatgtcattttaacagagcgtgggtttggtgactgtaggaaaggatttgaggacgctccttctgttcggcttcctatgtcatgagcacaggctccacgcacgcacagacaccacggctcccggatgctgtggctccccgatcggggctcctgcagcgccagaagcccctccgggatgcttcgaggggctcccggtgggtggaggtacggacgccgctgcggccgccgccgccagtcctgctgctgttgttgctgctgcagtcacgtgggagcccctttaagtttccatagagaggcctctctggtgtcacatgatggacatgatataatgaaacaacattgtggagaggaaagcattaggggagcccacggctacaaaaacaagtgagtgagaagaggtgggaggaagagaaactacgccacctcccctgcagccgagtgcacgcagcagcctggcgtgacaagtgggcgacgccggggggcagggagccggggtccttggccctggccggggaccccaccgcccaccgcgcggaggacaacttttagccggcagcccagaccagcgcggcacctgtctccggagtctccaccgctcctcccgattcatcccagggaaattctcaagaatacgctctacaaatctacgtgcgcatcattttcacctcgcgtcgcgcccgggaggaaggaacgaggcaaggagctaaagcagcgtgcgttcagccctggggcattttattaatgcttttacgagttagaagagttgggataatttgccatctggagtttctctgccttgctgatctgagctcagacctgccaatttaccagaggttgcagtgagctgagattgtgctataacactctagcctgagcaacagagcacgactctgtctgaaaaaaagaaacaaacaaaaaaaagtgttatttctgagaaataacactcagaaaaagaaaagattattaaacttttgttagcagaagaagtacatattgcctcttcatgaaggaatttcagtctttgttctctgtgctgacctgatattattaataaatttttttgataata

SEQ ID NO: 306578 - DNA, 2200 bp, Homo sapiens
cccacctgaaaaagaactgcagagggagtgtggtttgaaaagtcgtatcaaatgtagaaggattcaaagtccaagagaatcttactctgtttccctgtgcatctaactttttattgtgtcaccttaatttcttttgaagccacaagttatttgtttttcaaatctcttattatctgtgtatgtagtaattatgtcttcttaagattctatttaggaactcagtaaaattaggcaggtgaaataattggctaaagttcagtgaagcccttttggcactctgagtttggaaaatagcaaataataatgtaaaacattttgtgtgcatttgtacctactcactaacgatattctcctcctattttgcaggaggaaaatggaagaaacggagatacttttagtgaagcagaataaaccactgaacagatggagtctcactctgttgcccagactggaatgcagtggtgtgatctcaactgactgcaacctccgtatcctgggttcaagcaactctcctgctgcagccacgaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttgggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactaaagtctaggcaagtggctgagctaggtttgccatgaatcaatctgctgagtatatttcttggtaactagttcatctttccttaattcagtcaacaaatatgatatcaagtttagtaagatgatgacagatgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattgagggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcaaaaaa

SEQ ID NO: 306579 - DNA, 230 bp, Homo sapiens
tatcaggccacctgctactccaaagccatgaattaacttgttctaagccctcaaggaaagaaaagaggaaacagaggtttattccctatcaagacagtccacttgagaaagttctgtcttggttgtaacttcaggtttctttcttacacaggcattttattaatgcttttacgagttagaagagttgggataatttgccatctggagtttctctgccttgctgatctgag

SEQ ID NO: 306580 - DNA, 426 bp, Homo sapiens
cagcagcacgcagcctccagtcttgagtgactcctgggctttggctcagcagtaactcctccataaaaacaagtgtgtgcatctggctgttagaagaattcatgctcatccgggtaaggataaactggagaaattattcctttttttccctttgggtggttttgaggttttagaaaaattgatcctctctttgagaagagttcagaactatttgtctgaagtttttccatccaaactgctttatcgtattatccactgtcttacccttttcctgtgaaatctaccctcttcaaaacatagtttcattttcaaattttaaaagataagattccatttttctttccgtgcatgaaactttaaaaattaaatcaccacagttgctactggcttagaagtggggtcttatatttttaggaagtatacttt

SEQ ID NO: 306581 - DNA, 2190 bp, Homo sapiens
ggcacgaggcgtctctctgcccccgccgctgccatggcggcagctccgccgctttccaaggccgagtatctgaagcgttacttgtccggggcagatgccggcgtcgaccggggatctgagtccggtcgcaagcgtcgcaaaaagcggccgaagcctggcggggccggcggcaagggaatgcggattgtggatgatgatgtgagctggacagctatctccacaaccaaactagaaaaggaggaagaggaagatgatggagatttgcctgtggtggcagagtttgtggatgagcggccagaagaggtaaagcagatggaggcctttcgttccagtgccaaatggaagcttctgggaggccacaacgaagacctaccctcaaacagacattttcgtcacgataccccggattcatctcctaggagggtccgtcatggtaccccagatccatctcctaggaaggaccgtcatgacaccccggatccatctcctaggagggcccgtcatgacaccccagatccttctcccctcagaggggctcgtcatgactcagacacatctcctcccaggaggatccgtcatgactcctcagacacttcacccccaaggagggcccgtcatgattctccagatccttctcccccaaggaggcctcagcataattcttcaggtgcatctcctaggagagtccgtcatgattcaccagatccctctcctcctaggcgagcccgtcatggttcctcagatatctcttcccccagaagggtccataacaactcccctgacacatctaggaggactcttggctcttcagacacacagcaactcagaagggcccgtcatgactcccctgatttggctcctaatgtcacttattccctgcccagaaccaaaagtggtaaagccccagaaagagcctctagcaagacttctccacattggaaggagtcaggagcctcccatttgtcattcccaaagaacagcaaatatgagtatgaccctgacatctctcctccacgaaaaaagcaagcaaaatcccattttggagacaagaagcagcttgattccaaaggtgactgccagaaagcaactgattcagacctttcttctccacggcataaacaaagtccagggcaccaggattctgattcagatctgtcacctccacggaatagacctagacaccggagctctgattctgacctctctccaccaaggaggagacagaggaccaaatcttctgattctgacctgtccccgcctcgaaggagtcagcctcctggaaagaaggctgcacacatgtattctggggctaaaactgggttggtgttaactgacatacagcgagaacagcaggagctcaaggaacaggatcaagaaaccatggcatttgaagctgaatttcaatatgctgaaaccgtatttcgagataagtctggtcgtaagaggaatttgaaactcgaacgtttagagcaaaggaggaaagcagaaaaggactcagagagagatgagctgtatgcccagtggggaaaagggcttgcccagagccggcaacagcaacaaaatgtggaggatgcaatgaaagagatgcaaaagcctctggcccgctatattgatgacgaagatctggataggatgctaagagaacaggaaagagagggggaccctatggccaacttcatcaagaagaataaggccaaggagaacaagaataaaaaagtgagacctcgctacagtggtccagcacctcctcccaacagatttaatatctggcctggatatcgctgggacggagtggacagatccaatggatttgaacagaagcgctttgccaggcttgccagcaagaaggcagtggaggaacttgcctacaaatggagtgttgaggatatgtaactttcctgaggctgtgggggtggctgggctgtggtagtgggcataggcagcgagatatccagtggtaacagttgtctgtgctaataattggagcccacacagaccagcaacttgttgaatgccagttttgaccacagaagaatattcgagacctgatgtttggactgaggtacctgtacttcttgggtgtgacagcaccggctgttgctggctttcagaggaagcattgatttctcattgaccagggtttgttcttggtagggtttttctttttcttttttaaataaacatgtattt

SEQ ID NO: 306582 - DNA, 2077 bp, Homo sapiens
ggcacgaggcgtctctctgcccccgccgctgccatggcggcagctccgccgctttccaaggccgagtatctgaagcgttacttgtccggggcagatgccggcgtcgaccggggatctgagtccggtcgcaagcgtcgcaaaaagcggccgaagcctggcggggccggcggcaagggaatgcggattgtggatgatgatgtgagctggacagctatctccacaaccaaactagaaaaggaggaagaggaagatgatggagatttgcctgtggtggcagagtttgtggatgagcggccagaagaggtaaagcagatggaggcctttcgttccagtgccaaatggaagcttctgggaggccacaacgaagacctaccctcaaacagacattttcgtcacgataccccggattcatctcctaggagggtccgtcatggtaccccagatccatctcctaggaaggaccgtcatgacaccccggatccatctcctaggaggggcccgtcatgattctccagatccttctcccccaaggaggcctcagcataattcttcaggtgcatctcctaggagagtccgtcatgattcaccagatccctctcctcctaggcgagcccgtcatggttcctcagatatctcttcccccagaagggtccataacaactcccctgacacatctaggaggactcttggctcttcagacacacagcaactcagaagggcccgtcatgactcccctgatttggctcctaatgtcacttattccctgcccagaaccaaaagtggtaaagccccagaaagagcctctagcaagacttctccacattggaaggagtcaggagcctcccatttgtcattcccaaagaacagcaaatatgagtatgaccctgacatctctcctccacgaaaaaagcaagcaaaatcccattttggagacaagaagcagcttgattccaaaggtgactgccagaaagcaactgattcagacctttcttctccacggcataaacaaagtccagggcaccaggattctgattcagatctgtcacctccacggaatagacctagacaccggagctctgattctgacctctctccaccaaggaggagacagaggaccaaatcttctgattctgacctgtccccgcctcgaaggagtcagcctcctggaaagaaggctgcacacatgtattctggggctaaaactgggttggtgttaactgacatacagcgagaacagcaggagctcaaggaacaggatcaagaaaccatggcatttgaagctgaatttcaatatgctgaaaccgtatttcgagataagtctggtcgtaagaggaatttgaaactcgaacgtttagagcaaaggaggaaagcagaaaaggactcagagagagatgagctgtatgcccagtggggaaaagggcttgcccagagccggcaacagcaacaaaatgtggaggatgcaatgaaagagatgcaaaagcctctggcccgctatattgatgacgaagatctggataggatgctaagagaacaggaaagagagggggaccctatggccaacttcatcaagaagaataaggccaaggagaacaagaataaaaaagtgagacctcgctacagtggtccagcacctcctcccaacagatttaatatctggcctggatatcgctgggacggagtggacagatccaatggatttgaacagaagcgctttgccaggcttgccagcaagaaggcagtggaggaacttgcctacaaatggagtgttgaggatatgtaactttcctgaggctgtgggggtggctgggctgtggtagtgggcataggcagcgagatatccagtggtaacagttgtctgtgctaataattggagcccacacagaccagcaacttgttgaatgccagttttgaccacagaagaatattcgagacctgatgtttggactgaggtacctgtacttcttgggtgtgacagcaccggctgttgctggctttcagaggaagcattgatttctcattgaccagggtttgttcttggtagggtttttctttttcttttttaaataaacatgtattt

SEQ ID NO: 306583 - DNA, 2280 bp, Homo sapiens
aaatcagttttctccacctgcaccactgcatagcacagatacagaaaccatcctatttcaggatttgaatgcaaaacttaccttcttactctaaagatgaatgatcagggagagatttattcaaccctgagatttttgcagtctccttcagagtcacagaatagattaaggcctgatgatactcaaaggcctgggaaaactgatgacaaagaattttcagtgccctggcacctcattgcagtgactcttgggatcctctgtttacttcttctgatgatagtcacagtgttggtgacaaatatctttcagtgtattcaagaaaaacatcaacggcaggaaattctaagaaactgtagtgaaaagtacatcatgcaaaatgacaactacttaaaagagcagattttgacaaataagactttaaaatatgacgttctcaaaaatagctttcagcagaaaaaggaactggattcacgccttatacaaaagaacagatgtcatagagaaaatgagatcgtttttaaagttttgcaaaatacaggcaaattctctgaagaccacgggtcctgttgtggagtaaactgttattattttaccatgcagaagaaagactggaagggatgtaaacagacttgtcaacattgtagatcatcccttttgaagatagatgacaaagatgaactcgtattttacattcacttttattctcttggactctgtttctcaatgttggacctaagatattgaagacaggctggagtccagagccttcattcaatctcagatttatgaaaataattactggatcggattatcatatgatgaaagggaaagtaagtggaaatggattgataatggcacatctcctggaattaattctacaataatgcgtttttcttctgggagaggagaatgtgcatttttgacctcaacaagaatggcaactattgattgcattcaaacgtacaattgtatctgtgggaagagaatagactctattttctctgattcggtgtgcgccaagaagaaaaggtgaaaatggaatgttttctttttttgtttcccataataatttctgattataaatcattgcttttaactgtgggacttagttaattcttcaaaagataaagatgaacaggaagaaaaagaaaattattttggactatgactttaaagatcagatgccatctttcttcctggagaagaggagattttctcttttgagagtggttgttccttcctttaatgtccctgaggaattattcattctttccagcatcttctggttttgaaagcagttgtgaactagaatgtagttatttttttcttcccatctagaagttacctcatcttttaaaacatttgttttgctacaaaatataacttcaaacttactgaaagttgcaagcatagtacaaggaacttctatataacctttactcatacttactagttgtttatattttgctctgctttatatttctctctttctatcttccacttaataataaattgaggacttcatgtccctttgtctaaatattttccaagatcaagggctttgttttatataatcacagtgcaattatcaaactcaggaaatttagcattagtacagtactatgatctaatctgtaatccatgttcaaattttgtcaattgtcccaataatgccatttatatgtatttcttaaaaatccatgttcaggataattcaatgcatttgattgtaatgtctctttagtcttctttaatctgaaacagttctttaggctttttcttgaccttgacattttaaaaattaactttattgagttatacttttcatgcaataaaatgcactcactttaagtcatgaggaatatgggttttaacatatatacacacacacacacacacatatatatatatcttacacagtatgaaatcaagatatagaatattttcatcatctctaaaagttcctttctgcccttcgccacccactttgccccaggcaaccagggatgtgctttctatctgcaaattagtttaccctactctagaatttaatgcatcatgtactcttctgtatctggcttatttttacgcagcatgtttttgaattatatctatggttttgtgtatcagcatttcgttctttttcctactaggtagtattctattgtacagatataccacaatttatttcttcattcacctgtggacatttgatgtgtttccagtttttggctattgtgaataaaggtgccatgaacatttgtgtgcaaatatctgtgt

SEQ ID NO: 306584 - DNA, 273 bp, Homo sapiens
aagataaagatgaacaggaagaaaaagaaaattattttggactatgactttaaagatcagatgccatctttcttcctggagaagaggagattttctcttttgagagtggttgttccttcctttaatgtccctgaggaattattcattctttctaattctcagaactacctatacaaccagttagagaactctgatattatatcctgggtcttttttcttatcaataggataaatcattccagcatcttctggttttgaaagcagttgtgaact

SEQ ID NO: 306585 - DNA, 966 bp, Homo sapiens
gtcgttgattccctatgtgaagatcctgtatgtggataccttgattgtaaggctgagagattaaagaccatagtaacttttgttaagtggtctccttgtcactcacatacctttgctcctgagttcttccataggtgccactgaacagcttccttgaggtaaactcttctgaacttgtaacctacattaactgggatattaataatctcttttaatcttaatgctcttatgaaatgacataaaaagaagaaatgcattgcactgttgtatgagcagataagacaaaatactaattctctccttttccccccatcctatcttgttttctttctcagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaa

SEQ ID NO: 306586 - DNA, 1653 bp, Homo sapiens
aagtgattagtcactgaaggctagagaacaattccgagaaagagacggagagagagggaagaaaaagacagatagatattggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaa

SEQ ID NO: 306587 - DNA, 1712 bp, Homo sapiens
aagtgattagtcactgaaggctagagaacaattccgagaaagagacggagagagagggaagaaaaagacagatagatattggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaa

SEQ ID NO: 306588 - DNA, 1720 bp, Homo sapiens
  misc_feature (1661)..(1661): n is a, c, g, or t
  misc_feature (1671)..(1671): n is a, c, g, or t
  misc_feature (1691)..(1691): n is a, c, g, or t
aagtgattagtcactgaaggctagagaacaattccgagaaagagacggagagagagggaagaaaaagacagatagatattggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaaaaaagaanaaaaaaaatnattatatataattatttaantttagaatttttaaaatatatatatttag

SEQ ID NO: 306589 - DNA, 2196 bp, Homo sapiens
aagtgattagtcactgaaggctagagaacaattccgagaaagagacggagagagagggaagaaaaagacagatagatattggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaaaaaaaaaaaaaaaaaaaaaacaaaaaaaacaaaacacaaacaaaaaaaaaaaacaagaaaacaaaaaaaaaacaaaaaaaagaagaaatggcacagaaaccaaagaaaacacaaccacaaaaaaaggggggggggcgcccaccaaatagacaaacgggggaggcgactcccgccccgcacatttttgaagagaggcccccacagacgggcgacataataacaagaacggagagcgagggcagaccaaacacaacctaagtgaagggggacgaacaggcacgacgggtacgaagacgtaggagaaaagaacccactaggttggggaagggagcacaaatggtgcgcacccccccacaaggagagaaatgcgctcgcgggaaaaacaaatagcaggcaagaggttatgatgacacaacaatattactgcgcagacagaaagagccgagaataataaaatacaggcggggtcgatatagcggggagg

SEQ ID NO: 306590 - DNA, 1408 bp, Homo sapiens
gactctgaggatcctcgtgcaactgctcggagtgggtggagaagaagggagaaggcaccactacatccgaagcagtggagagggggggaataagaaagagagagaaggaaaggagagaaggcaggaagaaggcaagggacgagacaaccatgctgtgctgtatgagaagaaccaaacaggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaa

SEQ ID NO: 306591 - DNA, 1590 bp, Homo sapiens
aaacaaagcagcctaggcaatggtgggcgcccctcccccagcctcgctgccgccttgcagtttgatctcagactgccctgctagcaatcagcgagactccgtggacgtaggaccctccgagccaggtgcaggatatgatctcctggtgcgccgcttttttaagcccgtcggaaaagcgcagtattcgggtgggagggaccggattttccagtgagatgaacccagtacctcagatggaaatgcagaaatcacccgtcttctgcgtcgctcacgctgggagctgtagaccggagctgttcctattcggccatcttggctcctcccgacattcgatgtttcaccatcaagtatgacattagctgttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaa

SEQ ID NO: 306592 - DNA, 2049 bp, Homo sapiens
aagtgattagtcactgaaggctagagaacaattccgagaaagagacggagagagagggaagaaaaagacagatagatattggggggaaggagaaaaaaggagaagagagggaagagaggacagcggagagagagcaccagagagagagggagagagagagagagcgctagagagagggagcgagcatgtgcgatgagcaatagctgtggaccttacagttgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaaccatgctgtgctgtatgagaagaaccaaacagaattaaaagggaacctggtctctgggttgttttcaacatctcaagtgtgaattttccctgtcaaaatcttcacaaggaaaatgagtcacagcatcacctgggtgacgaggtcataacacctcagcccttgcttaaaaaattttatttctacttttctattgtaaagagatctcaaaacaggaagataaaattggactgacagctctacagcctagtcttttagacagtgaactaggccagcattggcagacactggcgatgacaaagtcctgctctgaattatgccaccccgcactccactttttaccttgcctgggaggcttgaggaaaaatcttcagagagcagttcgacctagtccttattcacttggcttcttgactttctggatttcaagggttgaaaaaaatgatgacgaccaaaagattgaacaagatggtatcaaaccagaagataaagctcataaggccgcaaccaaaattcaggctagcttccgtggacacataacaaggaaaaagctcaaaggagagaagaaggatgatgtccaagctgctgaggctgaagctaataagaaggatgaagcccctgttgccgatggggtggagaagaagggagaaggcaccactactgccgaagcagccccagccactggctccaagcctgatgagcccggcaaagcaggagaaactccttccgaggagaagaagggggagggtgatgctgccacagagcaggcagccccccaggctcctgcatcctcagaggagaaggccggctcagctgagacagaaagtgccactaaagcttccactgataactcgccgtcctccaaggctgaagatgccccagccaaggaggagcctaaacaagccgatgtgcctgctgctgtcactgctgctgctgccaccacccctgccgcagaggatgctgctgccaaggcaacagcccagcctccaacggagactggggagagcagccaagctgaagagaacatagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaa

SEQ ID NO: 306593 - DNA, 684 bp, Homo sapiens
gaccatcacctactcctaataatgcattatataataaaacggcgtatccctacaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaa

SEQ ID NO: 306594 - DNA, 707 bp, Homo sapiens
  misc_feature (49)..(49): n is a, c, g, or t
gaatagaaacacacataaaaagaggcgaagggacctgagaacccgcaanccgcgcgcacacgccctcctcccgtttaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaa

SEQ ID NO: 306595 - DNA, 1236 bp, Homo sapiens
  misc_feature (841)..(841): n is a, c, g, or t
  misc_feature (848)..(848): n is a, c, g, or t
  misc_feature (853)..(853): n is a, c, g, or t
  misc_feature (859)..(859): n is a, c, g, or t
tccgacggcagtacttcccggtgtaatggtacgaggcctgggtggtcgcttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggagagttgnagaggantttgncgctgngaccctcctgtgtcagttggggggaaccttgtcccagcggtgtggccttgaggtcccgccaggagggcgtttgccgaagggccggcttcgtgggatgcctgttgtgccaccccccccaccacagtgtcgtgggatttctcccccggggcgtaggagggagcaggttgtaccccgttaggggcgcccggtgttttgtccgcgacgaacgaggagaacaccgagcacacgtgggaggagaggcaccgtgtgcgcgaacccgcccctattgtggtgggcccgcccccccctcccgtcattgggggctggttttaaaaactagctatagtcgagcgccaggctggtggtcgtcacatgttcatctgtagccactggtacga

SEQ ID NO: 306596 - DNA, 442 bp, Homo sapiens
  misc_feature (16)..(16): n is a, c, g, or t
  misc_feature (18)..(18): n is a, c, g, or t
gggaaggtggaaaccntnatggacactgtggtaggcacccaaaggggaagggggcgcaaagggtcaagcatccggaacaagggggccccgaccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaa

SEQ ID NO: 306597 - DNA, 3231 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306598 - DNA, 3210 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaa

SEQ ID NO: 306599 - DNA, 3411 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagctcggggtccaggctatcagggcgtctggggcgctcagagagcctgcgggtgagtgaccgccgccggccttcccggggcagcctcggggctaagggccggggtgggggccgctcccggagcgacgtggacatggaccccagttccgccacggcagtgcttggccctgcccgacgagccacccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306600 - DNA, 3111 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaa

SEQ ID NO: 306601 - DNA, 2113 bp, Homo sapiens
tagtctagagatcccgtggagcaggacactgaccggggttgaacgctctaagaggctgaaggctgcttcttgggatggcccaagctggggccctaacaaggcctctgtccacagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306602 - DNA, 3729 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcaggtgaggggggccatggagagagctggaggttcagggagtggggccggaaggcggggcaggcttccctccacaactccagaaccgtctctgtgtgagcatgcacatgtgtgaatgcatgtgtgtgcatacatgtgtgtctgtacgcaagtatgtgactgtgcgtgcatatatagtgtgtgtatgcatgcatgtgtgcgtgtgcatgtgtgtgcgtgtatggtgtgtgtgtatgcatatgtgtgcatgcgtgtgacagcatgtgcatgcatgtgtgtgtgtgtgcgcatgtgccgaccccaccactgccccgtctgtctcctgtctccaggcctctgtgtcttccattgtctgggcctctctgtctccctgtctcccggcctcgacctctgtctctgtctccggacctccctgcctccccacctccagctctctgtctccctgcccctgcggccccccagggccaggggtgtggggtcacccagcacttcctcccctcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306603 - DNA, 3067 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306604 - DNA, 2926 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaaggtagcccagctctgcccctccagggtggccaccagcccaaacagtgcctctgttccaactagaacaaggctctccacgtcaaaaatttccttacgcccagctgccagaaaacaaatgctccaaacccacccagcctgcaccactgtcctgggtgcccacgtccctcttctgcagccaccatcccttgcttgattctatatttagcctcttcctgaacacatctctgtcttcagtaccttcctgccctgtcccaaccctaaacccagcctcacttcttcacctccctttggatccccgaaccccatctgctcagccttgcctggc

SEQ ID NO: 306605 - DNA, 1931 bp, Homo sapiens
ttaaggctagtagaggccgggttgaaatcggcagagggctgccaagagttccaggtgaagcggaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306606 - DNA, 1301 bp, Homo sapiens
  misc_feature (13)..(13): n is a, c, g, or t
cggggaggaaaanaaaaaacataggctaggtacgaggcctgggtggttgcttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306607 - DNA, 1649 bp, Homo sapiens
  misc_feature (1636)..(1636): n is a, c, g, or t
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagaggtgcccaggctggggtgcaggggcgggaggtgtggcttactgggcgctggtgggtgggtgcagggtcaccgctgccatctgtgcctgcctgtcccaggctcttgctccccatgctcctctgctgctctctgggtctggccattcctctcccttcttctttccttttctcatctccctcctgcttcctcattgcccccctttccttttatccttcctttttcctctgctccttcctctccttccttttttcactaatccttctcctcctcccttcctctccaccactccttccatctcctttatttccccctcctctctcacctcccctctcctctctcacctcccccatcctctctcacctcccccctcctctctcacctacccgactcgccttaaggatcctnaagtaccaacagc

SEQ ID NO: 306608 - DNA, 967 bp, Homo sapiens
aggtttctgggttcccagggacaggagggctgtggggaggccctggcatagggtctgggggctctgactgcccagggatttggcctttctccccagctggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306609 - DNA, 1662 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagaggtgcccaggctggggtgcaggggcgggaggtgtggcttactgggcgctggtgggtgggtgcagggtcaccgctgccatctgtgcctgcctgtcccaggctcttgctccccatgctcctctgctgctctctgggtctggccattcctctcccttcttctttccttttctcatctccctcccccaagaccccccactaccccagtgcccctaaaatcccaccactcctctgactctctcctctcttctgttgcatgtttgatccctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaa

SEQ ID NO: 306610 - DNA, 1418 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagaggtgcccaggctggggtgcaggggcgggaggtgtggcttactgggcgctggtgggtgggtgcagggtcaccgctgccatctgtgcctgcctgtcccaggctcttgctccccatgctcctctgctgctctaaccccaccctctcccatcttcctcatctcttctttgcctcctccttggtgcataaaa

SEQ ID NO: 306611 - DNA, 2229 bp, Homo sapiens
  misc_feature (686)..(686): n is a, c, g, or t
  misc_feature (1882)..(1882): n is a, c, g, or t
  misc_feature (2016)..(2016): n is a, c, g, or t
  misc_feature (2081)..(2081): n is a, c, g, or t
  misc_feature (2130)..(2130): n is a, c, g, or t
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctggtgagggcagggctgggtgggcacagggaggggtggggctgggacaggcacagcttttagcgaattaaaccagcgagctagtgcctggagggtctggaaaagcagatctagaacacagagagccagatctagaaagagagaatgctttagacaagagccagaaagcatgccacgtgacctcaacaggcttacaagtgcccagggtagatctcagtgcgcagcgggcagggtacacacgtcaggaccccgcggagccacagagagtccagcagcctggcagaaaccacatcccatcccactctgtgcctgtggcagcgcccccatcagcctgtggcagcacctttccgtgnactctaggggaccaaattcttctctccaaagcctttttggcagatgccagcacgcagtcattcacggttgatggttgggaaaaagaagctgttagccatcccaggtctagggagcacagcaggccctgatctggaaacaagaaaaccaccacacacagctcacaaggcagaccacacaattgtggatccagaagcctccggatgaggcagaagatacctgggagatgtggatggacaaccgtgccatccagaaacacccgcagagtctagaaaacccagcaggtgatttagaaagggagaggccacagtgctggctggcaggggatctgtagacaagggtctcatcccaagaagaccccgtccagcccagcacaggataggaggacagcctggggacagccagggcactgcaccatgtggacatgcatagtggacccctccagaaaacaaggaaaccgatagagtggggagaagtgcccgaggcatgcagaaagaagaacatgtcagctgcaagaccagaggctggtcatccggacgccaaaccatcagatatgcagaaaattaggaaattgcagtctttcccctgtctacattctctttccagaagagtggttcccccgacaaccacatgcacggagactctggccctctgagcaagggagtcccctattcaagccttggggtttctagaacaccagattgtggacatcagcccagggatcgtgctgactaccatgttcttttacagatgtggaaaccgaggcctagagagggtcagggacttgcctgaggtgaccccggcggcctctgggcattttgaggtttattctcgcatagctccctcacctcatcagcttgtggggagccgatcagagatagctgtggtcccctgggcagcttcctgttggcctgtcttagaattttgctatatttggggggtgtgaagagtggatatagatgtgttaaaactgtttaaagtggagaaggaggaccgggcctggtggttcatgactgtagtcccaacgctttgggaggctgaggcaggaggatagcttgagcctgggaggttgaggctgcagtgattgcaccactgcactccagcctgggcgacaagagtgaaaccctgtcttgaaaaaaaaaaaaaagtggggccgggcatggtggctcacacctataatcccagaactttggaggcngaggtgggtagatcacttgagatcaagagttcgagaccagcgtggccaacatggtaaaaccccgtctctactaaaaatatgaaaattggccaggcgcagtgactcacgcatataatcccagcactttgggaggntgaggcaggtggatcacccgacgtcaggagttcaagaccagcctggccaacatggtgaaatcccntctctactaaaatagaaaaattagccaggcacagtggtacacacctgtnattccagctactcgggaggctgaggcaggagactcacttgaacctgggaggtggtggttgcaatgagccgagattgcaccattgcactccagcctaggc

SEQ ID NO: 306612 - DNA, 581 bp, Homo sapiens
cctgtcctggtcacccttgccccggtcctggtctctccctgtctctgtccctgtcctggtctctccccgtctctgtccctgtcctcgtctctccccaatttctgtccctgccctggcctctccccacctctgtccctgccctggtctctccccgtctctgtccctgtcctggtttctcttcgtctctgttcttgtcttggtctctccttgtctctgtccccggcatctgcctgactctgtccttggcctcggggtccaggctatcagggcgtctggggcgctcagagagcctgcgggtgagtgaccgccgccggccttcccggggcagcctcggggctaagggccggggtgggggccgctcccggagcgacgtggacatggaccccagttccgccacggcagtgcttggccctgcccgacgagccacgtatgtcaaccctctcccttcccccatccactaaggcagcctggagaatcagggagggattgttgtcagagtcacagaggaatgggcgttggagaccgaggtcattgaggccaactgtggtcacagaccttggaggaggagggggtagaatgct

SEQ ID NO: 306613 - DNA, 527 bp, Homo sapiens
cctgggtctgagggaggaaggcctggggcctggacctctgggtctgagggaggaggggctgggggcctggactcctgtgtctgagggaggaggggttgagggctcctgggtctgagggaggaaggggctccttgtcatggtggggaagggcctgagcacagcctcttgcatcccctggcggttgtggatttgagttactgttctcttatctccctctttctccctcactgtctccccagccgagaagccaggtgctacagaccggaagggaggcgtggggatgccctctcgggaccggaatatcggggctcctgggcaggacacccctggagtctctctgcaccctctgtccctggacagcccagaccgggaaccaggtgagagtttcctgggccagggctccatgaggcccggcgatccagggtgggggtgctgcctgcccccttggcacccccagatagaagccattccccagcaacacctcccctttgctctcagcatccacttctccctgctcctggtcacca

SEQ ID NO: 306614 - DNA, 474 bp, Homo sapiens
cagggagtgcttcccagaggaagtggcagttgagtcccacagccataggatggccaggaggtgaggaaggcccttttcaaagggagagtgtggtttgaggcagggtgagggagcggagagtcatgctgtgtgtctcccccagctttgctgtctgcatgccgacatgctgggctcactgggccccaaggaggccaagaaggccttcctggacttctaccacagcttcctggagaagacagcggtgagagaccttcaagctgccccaaccctgcaatccctgtttgggcctgcagagtcaccatgcggtccccagcctctgccctgagggcagctgctgacccaggccttccccagcaccctcgcttagaccagggttcctggcagtcctcccggcctgcatctcagcacaccaagtcctcctcttcaccccattctctctcttgagcaggttctccgggtgccggtccctcccaa

SEQ ID NO: 306615 - DNA, 3357 bp, Homo sapiens
ggaaaggaaaataatctgcagaaacgagctgagcttgcaaagacttcatagttcccaagaattaaaaaaaaaaaaaaaaagaattccacttgatcaacttaattccttttctttatcttccctccatcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatcttaaaaaaaaaaaaaccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaa

SEQ ID NO: 306616 - DNA, 515 bp, Homo sapiens
tctccctgtctctctctccatctctccccgtctcccctcttctcctacatcccccaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaatgaaactttataaatatatacctctagggggggcccggttcctaatttcgcctatagtgagtctaattacaatttaatgggccgtcgttttacaatttattcactgggaaaaccc

SEQ ID NO: 306617 - DNA, 296 bp, Homo sapiens
cggcgaattcgtggtgctgctcggcgaattcgtggtgctgctcggcgaattcgtggtgctgctcggcgaattcgtggtgctgctcggcgaattcgtggtgctgctgacccaggccttccccagcaccctcgcttagaccagggttcctggcagtcctcccggcctgcatctcagcacaccaagtcctcctcttcaccccattctctctcttgagcaggttctccgggtgccggtccctcccaacgtcgcctttgaacttggtaaggagaaggatgggatgagggagaggtgtctag

SEQ ID NO: 306618 - DNA, 3220 bp, Homo sapiens
aggggtggggagagtgcggagcccgagcgcggaggcttcggttccggtggcggcgatggcttctctttccacctggagcagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306619 - DNA, 3132 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306620 - DNA, 3604 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagagagaaaaaaaaaacaaacaaaaaaaaaaaaaaaaaacaacaaaacaaaaaaaaacaacaacaaaaaacacaaaacaaaaaaacaacacacgagagcgggggggcgggccgcccaaagaacactccccacggcgggggccccacagcggacccagcgccacccgccgcaggatgtttgggacaaaaggggcgcgaccccccacaggggaggggcggacgcataaacacgaccgagcggagcgcgaggcgggcagacaatatgcaacaccgccggcgagagaaggggggaaaaaagaggagaaacgagcggggagacaactggcggagggaaggacccaccaacatccgacggggggggaggggaacaaaaaggggggagagacagccacgagg

SEQ ID NO: 306621 - DNA, 3076 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggtgagtggggcacctgggggccagggcgctgtcctgaaaggagggtccccctccagagctcgcatccctacagccccttctgtccatctccctctttgtcttttctgaatctccccactccacctcgtgtttctcatctctgtgtctctgtttctgataatctgtttctctgtctctgtgcccgcctgcctctccccacctccccttct

SEQ ID NO: 306622 - DNA, 2838 bp, Homo sapiens
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgctggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaaggtagcccagctctgcccctccagggtggccaccagcccaaacagtgcctctgttccaactagaacaaggctctccacgtcaaaaatttccttacgcccagctgccagaaaacaaatgctccaaacccacccagcctgcaccactgtcctgggtgcccacgtccctcttctgcagccaccatcccttgcttgattctatatttagcctcttcctgaacacatctctgtcttcagtaccttcctgccctgtcccaaccctaaacccagcctcacttcttcacctccctttggatccccgaaccccatctgctcagccttgcctggc

SEQ ID NO: 306623 - DNA, 1300 bp, Homo sapiens
tccgacggcagtacttcccggtgtaatggtacgaggcctgggtggtcgcttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306624 - DNA, 1465 bp, Homo sapiens
aggtttctgggttcccagggacaggagggctgtggggaggccctggcatagggtctgggggctctgactgcccagggatttggcctttctccccagctggtgtgctctcatcactgagactgccggatccctgaaagtccctgcccctgcctctcgccctaagccccggcccagcccgagcaggtgaggggggccatggagagagctggaggttcagggagtggggccggaaggcggggcaggcttccctccacaactccagaaccgtctctgtgtgagcatgcacatgtgtgaatgcatgtgtgtgcatacatgtgtgtctgtacgcaagtatgtgactgtgcgtgcatatatagtgtgtgtatgcatgcatgtgtgcgtgtgcatgtgtgtgcgtgtatggtgtgtgtgtatgcatatgtgtgcatgcgtgtgacagcatgtgcatgcatgtgtgtgtgtgtgcgcatgtgccgaccccaccactgccccgtctgtctcctgtctccaggcctctgtgtcttccattgtctgggcctctctgtctccctgtctcccggcctcgacctctgtctctgtctccggacctccctgcctccccacctccagctctctgtctccctgcccctgcggccccccagggccaggggtgtggggtcacccagcacttcctcccctcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306625 - DNA, 1119 bp, Homo sapiens
tattgaagacagagatgtgttcaggaagaggctaaatatagaatcaagcaagggatggtggctccagaagagggacgtgggtacccaggacagcatgtgcatgcatgtgtgtgtgtgtgcgcatgtgccgaccccaccactgccccgtctgtctcctgtctccaggcctctgtgtcttccattgtctgggcctctctgtctccctgtctcccggcctcgacctctgtctctgtctccggacctccctgcctccccacctccagctctctgtctccctgcccctgcggccccccagggccaggggtgtggggtcacccagcacttcctcccctcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatctaagaaagatctgtgtgtgtgatg

SEQ ID NO: 306626 - DNA, 2459 bp, Homo sapiens
  misc_feature (686)..(686): n is a, c, g, or t
  misc_feature (1882)..(1882): n is a, c, g, or t
ccagagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctggtgagggcagggctgggtgggcacagggaggggtggggctgggacaggcacagcttttagcgaattaaaccagcgagctagtgcctggagggtctggaaaagcagatctagaacacagagagccagatctagaaagagagaatgctttagacaagagccagaaagcatgccacgtgacctcaacaggcttacaagtgcccagggtagatctcagtgcgcagcgggcagggtacacacgtcaggaccccgcggagccacagagagtccagcagcctggcagaaaccacatcccatcccactctgtgcctgtggcagcgcccccatcagcctgtggcagcacctttccgtgnactctaggggaccaaattcttctctccaaagcctttttggcagatgccagcacgcagtcattcacggttgatggttgggaaaaagaagctgttagccatcccaggtctagggagcacagcaggccctgatctggaaacaagaaaaccaccacacacagctcacaaggcagaccacacaattgtggatccagaagcctccggatgaggcagaagatacctgggagatgtggatggacaaccgtgccatccagaaacacccgcagagtctagaaaacccagcaggtgatttagaaagggagaggccacagtgctggctggcaggggatctgtagacaagggtctcatcccaagaagaccccgtccagcccagcacaggataggaggacagcctggggacagccagggcactgcaccatgtggacatgcatagtggacccctccagaaaacaaggaaaccgatagagtggggagaagtgcccgaggcatgcagaaagaagaacatgtcagctgcaagaccagaggctggtcatccggacgccaaaccatcagatatgcagaaaattaggaaattgcagtctttcccctgtctacattctctttccagaagagtggttcccccgacaaccacatgcacggagactctggccctctgagcaagggagtcccctattcaagccttggggtttctagaacaccagattgtggacatcagcccagggatcgtgctgactaccatgttcttttacagatgtggaaaccgaggcctagagagggtcagggacttgcctgaggtgaccccggcggcctctgggcattttgaggtttattctcgcatagctccctcacctcatcagcttgtggggagccgatcagagatagctgtggtcccctgggcagcttcctgttggcctgtcttagaattttgctatatttggggggtgtgaagagtggatatagatgtgttaaaactgtttaaagtggagaaggaggaccgggcctggtggttcatgactgtagtcccaacgctttgggaggctgaggcaggaggatagcttgagcctgggaggttgaggctgcagtgattgcaccactgcactccagcctgggcgacaagagtgaaaccctgtcttgaaaaaaaaaaaaaagtggggccgggcatggtggctcacacctataatcccagaactttggaggcngaggtgggtagatcacttgagatcaagagttcgagaccagcgtggccaacatggtaaaaccccgtctctactaaaaatatgaaaattggccaggcgcagtgactcctgccttggcctcccaaagtgctaggattacaggcatgagccaccacgcctggccataaatatgttaaaaggttgatatagaaacagatgaccgtggcatttagagttttggggtgttgagggagtcaggggtaactccagaaaggattgatatctgtgaattgtcctgaagggtaagaaggaatcagcaaaactcccaaattaaaaactttaccaaaaacatttcatcttagtgctaagtctactattttctacaaaatacatatttctaaatttttcatttactattttaaaattcttagcttccctcctcatccctgattaaaaaaaattttttttttgccctttggcttcttacatttttaatgaatgtgtttatgagtactttggactccactgaaaaaaattagaagaggccaagagagtaggatgaagggccttccagacagggggaatagactgaaaaaaaaaa

SEQ ID NO: 306627 - DNA, 3469 bp, Homo sapiens
cgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtaagtgacataggaaccacaataggcttacttatttccaaatgtgacctacatttattggcaaaaggtttgggtagctgtattggtaactattttgaaacattacagctataattgaactgtttggacacagtactgtctttctgctttcatcaagggttacaggtacaggaatgcctacatttcatatggagatccaaagaagatcgtggagttgcggagttgttttgtgaacctcaccaaacatttaaatctcaaagcaattcctgagctacatctgcttcccaccttacgtttccaattgacaatttctttcccttaaaatgagctaatttcatagactcctttgtgaaaccataaatcgattattaggaaatttcacaaatatgcatacatgtaggttgtaatgttaaaatgtttaatttcacagaagccccactacagatgcttccttgttaaatgttatattaatattggagtccagaatgttctgagcattttccaactctgttccaaccttcctaatcctctcccttgtgagctgatgtgtataagcagatttaaatccttccctttctgtactaaagggagaaagaaaaggaagagatcaccctcagtgcttctttgctgctccttttctttagacatttaaccccttttagttcagaaaatgtaaactagcactagcatggtcttttaaggattttgttcatatcagtcatatatctgttattattttgtatttaaagattgtgtttattcccacgatttgaagaagcctagccaaaaaaaaaaaaaaaaagattgtgtttatattattgctagaagatatgtgttgatgggaccaaaaaaagactggttaataaataaaaattttttctacactaattatatataaaccatattcacatgtacctttattaatatatatataccactatgtaaagaacttcattgctcttttaatttagcttctctttcactgactaatattttggatcaaagtgagctcttcttttttggcacaaacttataatcctattatttaattctttccagctgctgacatatagtacataatttcagatgttttagtatgtttgatgaatatttcttttttttcaatttaccccatctgaaattacttcatagtctttccagctagtctttccatcgttgatacataattgccaaagtagccaagttgaactccctacttttaggattcttgagtcactactttggattcttcaaaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttatttcactcctactgaagtcgaaactaaattggatctaataggatct

SEQ ID NO: 306628 - DNA, 743 bp, Homo sapiens
aaagggaataaaaaatttaataataaataaagggaatctgagggtggtttaaggtttgaatctcaagctgagtttgggcaagttatttaactggctctctcagtctcagattcttcaggtgtaaaatgggatatcagagcaactcaaagcgttgctaaaataattacattagtttagcgtggtggttcctggaaaatagtaaatgttcaataaatgctgattgtaactttttattcacgttgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaaggtgtgtgtttgattgctagggtttggcacactcaagatattcaggaagtaattcttgagaaaacaaatgagtaatcacattttagattttctgatttctctcaccaggtgggaattattagatataaacagaaggttccctgtgtcaatgtaatagctagtaacttagaactttttcaacttcatttgtttagcaaatacagttgacccttgaacaatgtgggagttaggggtaccagcctccctccacagctgaaaattcatgtataacttttgacaccccaaaacttaactactaatagcctactcttgactgtaagccttactgataacataaacagttgattaacacatat

SEQ ID NO: 306629 - DNA, 3856 bp, Homo sapiens
cgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttatttcactcctactgaagtcgaaactaaattggatctaataggatctaagattggtgccttatttagggtgataggggtatagcaatgtctaattttgtgtgtcaaattgacttggccacagggggcccaaatatttcctttctttctttttaaaaaaataaatttttttagagatgggatctcactctgtcatacaggctggagtgtggtggcactatcctagttctatgaagcctcagactcctgggctcaagtgatcctcccacttcaacctccccagtagctgggacaacaggctcaagccaccatgcccagctaatttttaaaattattttgtagagacaaggtcttgctaggttgcctgaacttgtctcaaactcatgagctccagaaattctcccacctcagcctccaaaagtgctgggattataggcatgagccactgtgcccagcctcagatatttcattattctgggggtttctctgaaggtatttttcgatgagataaacatttgaatcagaagactaagtaaaacagatagtcctccctaatgtgggtgggcctcctccaatcatttgaagacatgagtagaataaaaaggctgacctttccccaggtaagagaattcctcctgcctgactggcttcaaattggaacatcagccttttcttgccttcagacacaaatggaaacatcagctgttggtctggagcctgctgaccttcagactggacctaaaccatcagctctcctaagtcttaggcctttggattcagactggaattatacctttagctctcctgggtctccagcttgccaatttaccctgcagatcttgggacttgtaagccttcataattgtgtgagcaatttcttataactctctctttctctctctctacatatatatatatatatatattttatatgtacacattcatacacacacacgcttatatgtatacatatagtatgtatatgtgtatatatattatgtatatacatatatgtgcacacatctctactaaaaatagaaaaattagccaggtgtggtggcatgtgcctgtagtcccagccactcgggaggcttaaatgggagaatcacttgaaccctggaggcagaggttgcagtgagccaggaccacgccactgcactccatccagcctgggtgacagagcaagactccatctcaaaaaaaaaaaggttagaaaaatgctgcttttagagagcctggccttgagagaggaaggaaagactagttgcagttaccattctctggtgagctctgactggctttttacaaacagggcttctctttggttgaagtcagccactaagttcatctttaaacatgctatctcaaattccccgaagccacccaaaatgtggtatgaatgaggatagagttacacagaattcagactgctttgccctctcagaacttctagggaacttcccttggtgtttccttccctaacgagctcagccacttgtaaccagcttattgaaagggctgtgaatgtattatgttgattccttttctgttccaggttattatcttgggaataacccatgttttgttttgttttaccctcagtcgctcataactatttaaaacagtatctcactttcaagtacagatgctcctctacttatggggctatgtctcaataaactcacgtaagta

SEQ ID NO: 306630 - DNA, 2375 bp, Homo sapiens
cgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttatttcactcctactgaagtcgaaactaaattggatctaataggatctaagattggtgccttatttagggtgataggggtatagcaatgtctaattttgtgtgtcaaattgacttggccacagggggcccaaatatttcctttctttctttttaaaaaaataaatttttttagagatgggatctcactctgtcatacaggctggagtgtg

SEQ ID NO: 306631 - DNA, 5564 bp, Homo sapiens
cgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaagctattgtaaaaggggttgagttcttgatttgattctcagcttggtcgctgttggtgtaaagaagagctactgatatgtgtatattaattttgtatccagaaacttcgctgaattcttttatcagttctaggagctttctggaggagtctttaggattttccaggacttcttctagtactgtgctgaagaggagtggagagagtgggcatccttatgttgtcccagttctcagagggaatgctttcaacttttccccattcagcattatgttggctgtgggtctgtcatagatggcttttattacattgaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtaagtgacataggaaccacaataggcttacttatttccaaatgtgacctacatttattggcaaaaggtttgggtagctgtattggtaactattttgaaacattacagctataattgaactgtttggacacagtactgtctttctgctttcatcaagggttacaggtacaggaatgcctacatttcatatggagatccaaagaagatcgtggagttgcggagttgttttgtgaacctcaccaaacatttaaatctcaaagcaattcctgagctacatctgcttcccaccttacgtttccaattgacaatttctttcccttaaaatgagctaatttcatagactcctttgtgaaaccataaatcgattattaggaaatttcacaaatatgcatacatgtaggttgtaatgttaaaatgtttaatttcacagaagccccactacagatgcttccttgttaaatgttatattaatattggagtccagaatgttctgagcattttccaactctgttccaaccttcctaatcctctcccttgtgagctgatgtgtataagcagatttaaatccttccctttctgtactaaagggagaaagaaaaggaagagatcaccctcagtgcttctttgctgctccttttctttagacatttaaccccttttagttcagaaaatgtaaactagcactagcatggtcttttaaggattttgttcatatcagtcatatatctgttattattttgtatttaaagattgtgtttattcccacgatttgaagaagcctagccaaaaaaaaaaaaaaaaagattgtgtttatattattgctagaagatatgtgttgatgggaccaaaaaaagactggttaataaataaaaattttttctacactaattatatataaaccatattcacatgtacctttattaatatatatataccactatgtaaagaacttcattgctcttttaatttagcttctctttcactgactaatattttggatcaaagtgagctcttcttttttggcacaaacttataatcctattatttaattctttccagctgctgacatatagtacataatttcagatgttttagtatgtttgatgaatatttcttttttttcaatttaccccatctgaaattacttcatagtctttccagctagtctttccatcgttgatacataattgccaaagtagccaagttgaactccctacttttaggattcttgagtcactactttggattcttcaaaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttatttcactcctactgaagtcgaaactaaattggatctaataggatctaagattggtgccttatttagggtgataggggtatagcaatgtctaattttgtgtgtcaaattgacttggccacagggggcccaaatatttcctttctttctttttaaaaaaataaatttttttagagatgggatctcactctgtcatacaggctggagtgtggtggcactatcctagttctatgaagcctcagactcctgggctcaagtgatcctcccacttcaacctccccagtagctgggacaacaggctcaagccaccatgcccagctaatttttaaaattattttgtagagacaaggtcttgctaggttgcctgaacttgtctcaaactcatgagctccagaaattctcccacctcagcctccaaaagtgctgggattataggcatgagccactgtgcccagcctcagatatttcattattctgggggtttctctgaaggtatttttcgatgagataaacatttgaatcagaagactaagtaaaacagatagtcctccctaatgtgggtgggcctcctccaatcatttgaagacatgagtagaataaaaaggctgacctttccccaggtaagagaattcctcctgcctgactggcttcaaattggaacatcagccttttcttgccttcagacacaaatggaaacatcagctgttggtctggagcctgctgaccttcagactggacctaaaccatcagctctcctaagtcttaggcctttggattcagactggaattatacctttagctctcctgggtctccagcttgccaatttaccctgcagatcttgggacttgtaagccttcataattgtgtgagcaatttcttataactctctctttctctctctctacatatatatatatatatatattttatatgtacacattcatacacacacacgcttatatgtatacatatagtatgtatatgtgtatatatattatgtatatacatatatgtgcacacatctctactaaaaatagaaaaattagccaggtgtggtggcatgtgcctgtagtcccagccactcgggaggcttaaatgggagaatcacttgaaccctggaggcagaggttgcagtgagccaggaccacgccactgcactccatccagcctgggtgacagagcaagactccatctcaaaaaaaaaaaggttagaaaaatgctgcttttagagagcctggccttgagagaggaaggaaagactagttgcagttaccattctctggtgagctctgactggctttttacaaacagggcttctctttggttgaagtcagccactaagttcatctttaaacatgctatctcaaattccccgaagccacccaaaatgtggtatgaatgaggatagagttacacagaattcagactgctttgccctctcagaacttctagggaacttcccttggtgtttccttccctaacgagctcagccacttgtaaccagcttattgaaagggctgtgaatgtattatgttgattccttttctgttccaggttattatcttgggaataacccatgttttgttttgttttaccctcagtcgctcataactatttaaaacagtatctcactttcaagtacagatgctcctctacttatggggctatgtctcaataaactcacgtaagtaaaaaatatcacaagttgaaaacacatttaataaccctgataagcccattgtaaagtaggcaaataagttggaccattgaaagttggggactatctgtattttagaagttttttcagcttaaaaattaccaagctctatccta

SEQ ID NO: 306632 - DNA, 4246 bp, Homo sapiens
cgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtaagtgacataggaaccacaataggcttacttatttccaaatgtgacctacatttattggcaaaaggtttgggtagctgtattggtaactattttgaaacattacagctataattgaactgtttggacacagtactgtctttctgctttcatcaagggttacaggtacaggaatgcctacatttcatatggagatccaaagaagatcgtggagttgcggagttgttttgtgaacctcaccaaacatttaaatctcaaagcaattcctgagctacatctgcttcccaccttacgtttccaattgacaatttctttcccttaaaatgagctaatttcatagactcctttgtgaaaccataaatcgattattaggaaatttcacaaatatgcatacatgtaggttgtaatgttaaaatgtttaatttcacagaagccccactacagatgcttccttgttaaatgttatattaatattggagtccagaatgttctgagcattttccaactctgttccaaccttcctaatcctctcccttgtgagctgatgtgtataagcagatttaaatccttccctttctgtactaaagggagaaagaaaaggaagagatcaccctcagtgcttctttgctgctccttttctttagacatttaaccccttttagttcagaaaatgtaaactagcactagcatggtcttttaaggattttgttcatatcagtcatatatctgttattattttgtatttaaagattgtgtttattcccacgatttgaagaagcctagccaaaaaaaaaaaaaaaaagattgtgtttatattattgctagaagatatgtgttgatgggaccaaaaaaagactggttaataaataaaaattttttctacactaattatatataaaccatattcacatgtacctttattaatatatatataccactatgtaaagaacttcattgctcttttaatttagcttctctttcactgactaatattttggatcaaagtgagctcttcttttttggcacaaacttataatcctattatttaattctttccagctgctgacatatagtacataatttcagatgttttagtatgtttgatgaatatttcttttttttcaatttaccccatctgaaattacttcatagtctttccagctagtctttccatcgttgatacataattgccaaagtagccaagttgaactccctacttttaggattcttgagtcactactttggattcttcaaaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagagacaacaaaaaaaaaaaaaaaaaaaaaaaaaactttgtctgggccgccctgggcccctgagaaaaaagtttttaaaaccattgtctgtgtgggcgcggcgcggccccgcgtttggtgtcttgtggttcccctgggccccaaatcgggtgttcccaaagggaaacctcgggggcatggaaacataggtgcgtttggagttttctctacacccaaataaaaaaaaaggaggcccggggtgacacaaccaggagcgctttttcgttgaaacaactccaaaaatgggaaacgttccaggaggagccaaagatccgtgtgtctatcaatcaaccagcaaggcagtgcacaacaggcagcgcccagataacacaaaaattaacggccccggccgtgaaggatagtaaagaaacagccagcaggacaacctagccaacaaacaagaccataacaagcagacaagcaacatccacacaagccaaagagaaggaggaaacaaagaaaaacgaagaggacaggcaaacaacagagcatagtaaggaaaaaccgcaaggccggccaggagtggcgacagcgagggaaaacagaagccagatgccgcccgagagccagatgaagggagcaccacagcgaggcaaaagagaagagagaatgacaatgagcagaataagaagacgcagcacacagcagagagcgcaaggagagcgctaggcgtaacagccacagaaggagacgtacagatgcaagtcaagagaaagacagcaagacctaacacagagatacagcgaaggagaaacggaaacgcacgagcaaccagcaggacgaggcagagacagaagcgagccaacagcgacacagagagaacgacagagag

SEQ ID NO: 306633 - DNA, 334 bp, Homo sapiens
gtagagacagcatcttgttgcccaggctggtctcgaactctggggctgaagtgattctccctcttcagcctcccagagttctgggattataggcacgagccaccatgcccagccttaatgttggtaagcttcttgatgtaagttttgtgatgcttataagcaaagattcaagttatatttttaaaagttagttttttttttacctaacaaatatttgtctaatgttattaatgacacattcttttcttcttcagaaaacagccttccacagaagtcagacgctgagctacaggaacggctatgcaattgttcgacgtccaacagttgggatagg

SEQ ID NO: 306634 - DNA, 2213 bp, Homo sapiens
cgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttatttcactcctactgaagtcgaaactaaattggatctaataggatct

SEQ ID NO: 306635 - DNA, 3998 bp, Homo sapiens
cgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttatttcactcctactgaagtcgaaactaaattggatctaataggatctaagattggtgccttatttagggtgataggggtatagcaatgtctaattttgtgtgtcaaattgacttggccacagggggcccaaatatttcctttctttctttttaaaaaaataaatttttttagagatgggatctcactctgtcatacaggctggagtgtggtggcactatcctagttctatgaagcctcagactcctgggctcaagtgatcctcccacttcaacctccccagtagctgggacaacaggctcaagccaccatgcccagctaatttttaaaattattttgtagagacaaggtcttgctaggttgcctgaacttgtctcaaactcatgagctccagaaattctcccacctcagcctccaaaagtgctgggattataggcatgagccactgtgcccagcctcagatatttcattattctgggggtttctctgaaggtatttttcgatgagataaacatttgaatcagaagactaagtaaaacagatagtcctccctaatgtgggtgggcctcctccaatcatttgaagacatgagtagaataaaaaggctgacctttccccaggtaagagaattcctcctgcctgactggcttcaaattggaacatcagccttttcttgccttcagacacaaatggaaacatcagctgttggtctggagcctgctgaccttcagactggacctaaaccatcagctctcctaagtcttaggcctttggattcagactggaattatacctttagctctcctgggtctccagcttgccaatttaccctgcagatcttgggacttgtaagccttcataattgtgtgagcaatttcttataactctctctttctctctctctacatatatatatatatatatattttatatgtacacattcatacacacacacgcttatatgtatacatatagtatgtatatgtgtatatatattatgtatatacatatatgtgcacacatctctactaaaaatagaaaaattagccaggtgtggtggcatgtgcctgtagtcccagccactcgggaggcttaaatgggagaatcacttgaaccctggaggcagaggttgcagtgagccaggaccacgccactgcactccatccagcctgggtgacagagcaagactccatctcaaaaaaaaaaaggttagaaaaatgctgcttttagagagcctggccttgagagaggaaggaaagactagttgcagttaccattctctggtgagctctgactggctttttacaaacagggcttctctttggttgaagtcagccactaagttcatctttaaacatgctatctcaaattccccgaagccacccaaaatgtggtatgaatgaggatagagttacacagaattcagactgctttgccctctcagaacttctagggaacttcccttggtgtttccttccctaacgagctcagccacttgtaaccagcttattgaaagggctgtgaatgtattatgttgattccttttctgttccaggttattatcttgggaataacccatgttttgttttgttttaccctcagtcgctcataactatttaaaacagtatctcactttcaagtacagatgctcctctacttatggggctatgtctcaataaactcacgtaagtaaaaaatatcacaagttgaaaacacatttaataaccctgataagcccattgtaaagtaggcaaataagttggaccattgaaagttggggactatctgtattttagaagttttttcagcttaaaaattaccaagctctatccta

SEQ ID NO: 306636 - DNA, 5033 bp, Homo sapiens
cgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtaagtgacataggaaccacaataggcttacttatttccaaatgtgacctacatttattggcaaaaggtttgggtagctgtattggtaactattttgaaacattacagctataattgaactgtttggacacagtactgtctttctgctttcatcaagggttacaggtacaggaatgcctacatttcatatggagatccaaagaagatcgtggagttgcggagttgttttgtgaacctcaccaaacatttaaatctcaaagcaattcctgagctacatctgcttcccaccttacgtttccaattgacaatttctttcccttaaaatgagctaatttcatagactcctttgtgaaaccataaatcgattattaggaaatttcacaaatatgcatacatgtaggttgtaatgttaaaatgtttaatttcacagaagccccactacagatgcttccttgttaaatgttatattaatattggagtccagaatgttctgagcattttccaactctgttccaaccttcctaatcctctcccttgtgagctgatgtgtataagcagatttaaatccttccctttctgtactaaagggagaaagaaaaggaagagatcaccctcagtgcttctttgctgctccttttctttagacatttaaccccttttagttcagaaaatgtaaactagcactagcatggtcttttaaggattttgttcatatcagtcatatatctgttattattttgtatttaaagattgtgtttattcccacgatttgaagaagcctagccaaaaaaaaaaaaaaaaagattgtgtttatattattgctagaagatatgtgttgatgggaccaaaaaaagactggttaataaataaaaattttttctacactaattatatataaaccatattcacatgtacctttattaatatatatataccactatgtaaagaacttcattgctcttttaatttagcttctctttcactgactaatattttggatcaaagtgagctcttcttttttggcacaaacttataatcctattatttaattctttccagctgctgacatatagtacataatttcagatgttttagtatgtttgatgaatatttcttttttttcaatttaccccatctgaaattacttcatagtctttccagctagtctttccatcgttgatacataattgccaaagtagccaagttgaactccctacttttaggattcttgagtcactactttggattcttcaaaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaagagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttatttcactcctactgaagtcgaaactaaattggatctaataggatctaagattggtgccttatttagggtgataggggtatagcaatgtctaattttgtgtgtcaaattgacttggccacagggggcccaaatatttcctttctttctttttaaaaaaataaatttttttagagatgggatctcactctgtcatacaggctggagtgtggtggcactatcctagttctatgaagcctcagactcctgggctcaagtgatcctcccacttcaacctccccagtagctgggacaacaggctcaagccaccatgcccagctaatttttaaaattattttgtagagacaaggtcttgctaggttgcctgaacttgtctcaaactcatgagctccagaaattctcccacctcagcctccaaaagtgctgggattataggcatgagccactgtgcccagcctcagatatttcattattctgggggtttctctgaaggtatttttcgatgagataaacatttgaatcagaagactaagtaaaacagatagtcctccctaatgtgggtgggcctcctccaatcatttgaagacatgagtagaataaaaaggctgacctttccccaggtaagagaattcctcctgcctgactggcttcaaattggaacatcagccttttcttgccttcagacacaaatggaaacatcagctgttggtctggagcctgctgaccttcagactggacctaaaccatcagctctcctaagtcttaggcctttggattcagactggaattatacctttagctctcctgggtctccagcttgccaatttaccctgcagatcttgggacttgtaagccttcataattgtgtgagcaatttcttataactctctctttctctctctctacatatatatatatatatatattttatatgtacacattcatacacacacacgcttatatgtatacatatagtatgtatatgtgtatatatattatgtatatacatatatgtgcacacatctctactaaaaatagaaaaattagccaggtgtggtggcatgtgcctgtagtcccagccactcgggaggcttaaatgggagaatcacttgaaccctggaggcagaggttgcagtgagccaggaccacgccactgcactccatccagcctgggtgacagagcaagactccatctcaaaaaaaaaaaggttagaaaaatgctgcttttagagagcctggccttgagagaggaaggaaagactagttgcagttaccattctctggtgagctctgactggctttttacaaacagggcttctctttggttgaagtcagccactaagttcatctttaaacatgctatctcaaattccccgaagccacccaaaatgtggtatgaatgaggatagagttacacagaattcagactgctttgccctctcagaacttctagggaacttcccttggtgtttccttccctaacgagctcagccacttgtaaccagcttattgaaagggctgtgaatgtattatgttgattccttttctgttccaggttattatcttgggaataacccatgttttgttttgttttaccctcagtcgctcataactatttaaaacagtatctcactttcaagtacagatgctcctctacttatggggctatgtctcaataaactcacgtaagtaaaaaatatcacaagttgaaaacacatttaataaccctgataagcccattgtaaagtaggcaaataagttggaccattgaaagttggggactatctgtattttagaagttttttcagcttaaaaattaccaagctctatccta

SEQ ID NO: 306637 - DNA, 5373 bp, Homo sapiens
cgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtaagtgacataggaaccacaataggcttacttatttccaaatgtgacctacatttattggcaaaaggtttgggtagctgtattggtaactattttgaaacattacagctataattgaactgtttggacacagtactgtctttctgctttcatcaagggttacaggtacaggaatgcctacatttcatatggagatccaaagaagatcgtggagttgcggagttgttttgtgaacctcaccaaacatttaaatctcaaagcaattcctgagctacatctgcttcccaccttacgtttccaattgacaatttctttcccttaaaatgagctaatttcatagactcctttgtgaaaccataaatcgattattaggaaatttcacaaatatgcatacatgtaggttgtaatgttaaaatgtttaatttcacagaagccccactacagatgcttccttgttaaatgttatattaatattggagtccagaatgttctgagcattttccaactctgttccaaccttcctaatcctctcccttgtgagctgatgtgtataagcagatttaaatccttccctttctgtactaaagggagaaagaaaaggaagagatcaccctcagtgcttctttgctgctccttttctttagacatttaaccccttttagttcagaaaatgtaaactagcactagcatggtcttttaaggattttgttcatatcagtcatatatctgttattattttgtatttaaagattgtgtttattcccacgatttgaagaagcctagccaaaaaaaaaaaaaaaaagattgtgtttatattattgctagaagatatgtgttgatgggaccaaaaaaagactggttaataaataaaaattttttctacactaattatatataaaccatattcacatgtacctttattaatatatatataccactatgtaaagaacttcattgctcttttaatttagcttctctttcactgactaatattttggatcaaagtgagctcttcttttttggcacaaacttataatcctattatttaattctttccagctgctgacatatagtacataatttcagatgttttagtatgtttgatgaatatttcttttttttcaatttaccccatctgaaattacttcatagtctttccagctagtctttccatcgttgatacataattgccaaagtagccaagttgaactccctacttttaggattcttgagtcactactttggattcttcaaaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagtctatcatgaacccttgtgaaatgaaatatttgaagacacagatatgaagggaccaaggaaaagctttgttcctaccccatctttcatgtacccacttcttaccctccactccccatagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttatttcactcctactgaagtcgaaactaaattggatctaataggatctaagattggtgccttatttagggtgataggggtatagcaatgtctaattttgtgtgtcaaattgacttggccacagggggcccaaatatttcctttctttctttttaaaaaaataaatttttttagagatgggatctcactctgtcatacaggctggagtgtggtggcactatcctagttctatgaagcctcagactcctgggctcaagtgatcctcccacttcaacctccccagtagctgggacaacaggctcaagccaccatgcccagctaatttttaaaattattttgtagagacaaggtcttgctaggttgcctgaacttgtctcaaactcatgagctccagaaattctcccacctcagcctccaaaagtgctgggattataggcatgagccactgtgcccagcctcagatatttcattattctgggggtttctctgaaggtatttttcgatgagataaacatttgaatcagaagactaagtaaaacagatagtcctccctaatgtgggtgggcctcctccaatcatttgaagacatgagtagaataaaaaggctgacctttccccaggtaagagaattcctcctgcctgactggcttcaaattggaacatcagccttttcttgccttcagacacaaatggaaacatcagctgttggtctggagcctgctgaccttcagactggacctaaaccatcagctctcctaagtcttaggcctttggattcagactggaattatacctttagctctcctgggtctccagcttgccaatttaccctgcagatcttgggacttgtaagccttcataattgtgtgagcaatttcttataactctctctttctctctctctacatatatatatatatatatattttatatgtacacattcatacacacacacgcttatatgtatacatatagtatgtatatgtgtatatatattatgtatatacatatatgtgcacacatctctactaaaaatagaaaaattagccaggtgtggtggcatgtgcctgtagtcccagccactcgggaggcttaaatgggagaatcacttgaaccctggaggcagaggttgcagtgagccaggaccacgccactgcactccatccagcctgggtgacagagcaagactccatctcaaaaaaaaaaaggttagaaaaatgctgcttttagagagcctggccttgagagaggaaggaaagactagttgcagttaccattctctggtgagctctgactggctttttacaaacagggcttctctttggttgaagtcagccactaagttcatctttaaacatgctatctcaaattccccgaagccacccaaaatgtggtatgaatgaggatagagttacacagaattcagactgctttgccctctcagaacttctagggaacttcccttggtgtttccttccctaacgagctcagccacttgtaaccagcttattgaaagggctgtgaatgtattatgttgattccttttctgttccaggttattatcttgggaataacccatgttttgttttgttttaccctcagtcgctcataactatttaaaacagtatctcactttcaagtacagatgctcctctacttatggggctatgtctcaataaactcacgtaagtaaaaaatatcacaagttgaaaacacatttaataaccctgataagcccattgtaaagtaggcaaataagttggaccattgaaagttggggactatctgtattttagaagttttttcagcttaaaaattaccaagctctatccta

SEQ ID NO: 306638 - DNA, 3374 bp, Homo sapiens
cgtgggagttccggatgtttagcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtaagtgacataggaaccacaataggcttacttatttccaaatgtgacctacatttattggcaaaaggtttgggtagctgtattggtaactattttgaaacattacagctataattgaactgtttggacacagtactgtctttctgctttcatcaagggttacaggtacaggaatgcctacatttcatatggagatccaaagaagatcgtggagttgcggagttgttttgtgaacctcaccaaacatttaaatctcaaagcaattcctgagctacatctgcttcccaccttacgtttccaattgacaatttctttcccttaaaatgagctaatttcatagactcctttgtgaaaccataaatcgattattaggaaatttcacaaatatgcatacatgtaggttgtaatgttaaaatgtttaatttcacagaagccccactacagatgcttccttgttaaatgttatattaatattggagtccagaatgttctgagcattttccaactctgttccaaccttcctaatcctctcccttgtgagctgatgtgtataagcagatttaaatccttccctttctgtactaaagggagaaagaaaaggaagagatcaccctcagtgcttctttgctgctccttttctttagacatttaaccccttttagttcagaaaatgtaaactagcactagcatggtcttttaaggattttgttcatatcagtcatatatctgttattattttgtatttaaagattgtgtttattcccacgatttgaagaagcctagccaaaaaaaaaaaaaaaaagattgtgtttatattattgctagaagatatgtgttgatgggaccaaaaaaagactggttaataaataaaaattttttctacactaattatatataaaccatattcacatgtacctttattaatatatatataccactatgtaaagaacttcattgctcttttaatttagcttctctttcactgactaatattttggatcaaagtgagctcttcttttttggcacaaacttataatcctattatttaattctttccagctgctgacatatagtacataatttcagatgttttagtatgtttgatgaatatttcttttttttcaatttaccccatctgaaattacttcatagtctttccagctagtctttccatcgttgatacataattgccaaagtagccaagttgaactccctacttttaggattcttgagtcactactttggattcttcaaaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaaggtgtgtgtttgattgctagggtttggcacactcaagatattcaggaagtaattcttgagaaaacaaatgagtaatcacattttagattttctgatttctctcaccaggtgggaattattagatataaacagaaggttccctgtgtcaatgtaatagctagtaacttagaactttttcaacttcatttgtttagcaaatacagttgacccttgaacaatgtgggagttaggggtaccagcctccctccacagctgaaaattcatgtataacttttgacaccccaaaacttaactactaatagcctactcttgactgtaagccttactgataacataaacagttgattaacacatat

SEQ ID NO: 306639 - DNA, 593 bp, Homo sapiens
  misc_feature (4)..(5): n is a, c, g, or t
gaanncctgcaaacccagcgcaactacggtcccccggtcagacccaggatggggccagaacggacaggggccgcgccgctgccgctgctgctggtgttagcgctcagtcaaggtaagcggggatttcgctctgcatcggctgcaggagggacccgcgcggcttcctggggctcgctggagggattgggcggaactagggagcgagctccgtgtgttccctcggattccacgtggactcgggctcccagccaccaggacctgcttggaaagagatacttcttcgttcccttcctgctatcccaggccttgcgtccccattaggcgcgtctcgccctgtctgttaagcaccctccaaagtcatctcagtgagtgtgtgtgtgtgtgtgtagggggttgagggaagcagggtatccaatgaagcatctcttccttcgggggagaatgtgggaactagattacagccttccaggaactgtgtggctgcttttacagaaatgaactctgcatatcttgctggggggtggttggggtgagcctgtatgtgtgtgtgttgtccgcgcgtgtgtgtcggaagagacccgaggtacgagcca

SEQ ID NO: 306640 - DNA, 7596 bp, Homo sapiens
  misc_feature (4)..(5): n is a, c, g, or t
gaanncctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttgggtatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcgatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggatggactttgcatttctgatctagtcctagatgtccgacaaataccagctgctcaagaacaaccctttattgtcagcaaccaaaacaaaaggttaacattttcagtaacactgaaaaataaaagggaaagtgcatacaacactggaattgttgttgatttttcagaaaacttgttttttgcatcattctccctaccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgcatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttttgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcgtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtgagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaa

SEQ ID NO: 306641 - DNA, 7514 bp, Homo sapiens
  misc_feature (4)..(5): n is a, c, g, or t
gaanncctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttgggtatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcgatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggatggactttgcatttctgatctagtcctagatgtccgacaaataccagctgctcaagaacaaccctttattgtcagcaaccaaaacaaaaggttaacattttcagtaacactgaaaaataaaagggaaagtgcatacaacactggaattgttgttgatttttcagaaaacttgttttttgcatcattctccctaccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgcatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttttgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcgtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtgagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaa

SEQ ID NO: 306642 - DNA, 7621 bp, Homo sapiens
  misc_feature (4)..(5): n is a, c, g, or t
gaanncctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttgggtatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcgatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggatggactttgcatttctgatctagtcctagatgtccgacaaataccagctgctcaagaacaaccctttattgtcagcaaccaaaacaaaaggttaacattttcagtaacactgaaaaataaaagggaaagtgcatacaacactggaattgttgttgatttttcagaaaacttgttttttgcatcattctccctaccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgcatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttttgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcgtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtgagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaattatataaacaactttgtaggactatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaa

SEQ ID NO: 306643 - DNA, 7542 bp, Homo sapiens
  misc_feature (4)..(5): n is a, c, g, or t
gaanncctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttgggtatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcgatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggatggactttgcatttctgatctagtcctagatgtccgacaaataccagctgctcaagaacaaccctttattgtcagcaaccaaaacaaaaggttaacattttcagtaacactgaaaaataaaagggaaagtgcatacaacactggaattgttgttgatttttcagaaaacttgttttttgcatcattctccctaccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgcatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaaggtttgtttggctgactggcagtaacctagtgaatttttgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcgtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtgagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaa

SEQ ID NO: 306644 - DNA, 4901 bp, Homo sapiens
  misc_feature (4)..(5): n is a, c, g, or t
gaanncctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttgggtatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcgatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggatggactttgcatttctgatctagtcctagatgtccgacaaataccagctgctcaagaacaaccctttattgtcagcaaccaaaacaaaaggttaacattttcagtaacactgaaaaataaaagggaaagtgcatacaacactggaattgttgttgatttttcagaaaacttgttttttgcatcattctccctaccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgcatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagactaaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttttgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgcgacgtcgtcaatgtgatatcggacatcgactgtatctcagcagacagctctgatcatgcttacagaattcatccgca

SEQ ID NO: 306645 - DNA, 2175 bp, Homo sapiens
  misc_feature (4)..(5): n is a, c, g, or t
gaanncctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttgggtatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcgatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggagttgaagattcagagagaacagtgtgaaggtcatgtgattcaaggtcaaaaataagtatattgggccggcaagggaatagaatcagaaagaagttgtttattcaatcaagaatctccattcatttgtctctgtcaaaaaatgtgctttaaatgtacaaatatttgaagaacagaaaaataat

SEQ ID NO: 306646 - DNA, 366 bp, Homo sapiens
caaaggaatttatgttagtcttagaaacatacattggacgataagcccataggcaagcatttctttttatttggtgcttttgtaactaaaagtaaaatttactttaacctaagctataagatacttaaataaaagaaatattaaccttcaagaacaaaagcaaactaaaatatttggctttacaaacatcatccaacagatctaccaacataaatttttatgaaatctcttcggatgggaatgttccttcaatcgtgcacagttttgaagatgttggtccaaaattcatcttctccctgaaggttggtaagcctgtcataaggatggcaaatccaggagaaagtgagaagaaaaaaaatgagtctg

SEQ ID NO: 306647 - DNA, 717 bp, Homo sapiens
tcatatcatgccatgtacacttacatcatcatatgtgctttcccacttccctctgcctagaaaactccatgtccttcttactttgcaatttgaatgatattttaactttctaagccttcctgactctcctgctctctgatcactcagcctttgggacttgcctctattacaatttattttactatagaagcttaattatttattctccctgcctctacccctcctgccttttgctatgacaaacctcacatacctacaaaaggtttgccttataagtatgtctttgaccccctggcatcagaaacacctggaatgctaatttaaattgctgtgttctggatcacatcctagacattacttcagaatctctagaaatgggtctcagggatctgtatttcaaaggcattttcttggagattcttgtgcacactaagatttaagaaccaggtgttagatggtgttagaacctgagggaaggaactgtgctctctgtcttcatgttccaagcactttgcaaatagtaaacactcaatttttgtgtattgaatgagcaagtaaatgttcagtgtaatattagaagtatatgaatcctaggaattctaagtttaacatgttttattactccagattggctcctattttggtagtgtgctgtgttcagttgatgtggataaagacaccattacagacgtgctcttggtaggtgcaccaatgtac

SEQ ID NO: 306648 - DNA, 271 bp, Homo sapiens
ttttcttttaatatctttaagtaaacgaggaatttttaatcacttttaaaaattgttttccctttgaaagcttcaacaagcattccaaatgttactgagatgaaaaccaacatgagcctcggcttgatcctcaccaggaacatgggaactggaggttttctcgtgagtgtttactttacaaatcattattcctctcaagaaagtacatagacagtagtgtcttctcaccatccctcccaatctgaggatttagatgtttagaacttgcttt

SEQ ID NO: 306649 - DNA, 683 bp, Homo sapiens
  misc_feature (30)..(30): n is a, c, g, or t
  misc_feature (65)..(65): n is a, c, g, or t
ttcatggaatctggtgtttattacactcgngggagagaggaggtcactcggtccagcggtggccnagtgtggggctgtcacacgtagtaaaggcgcatgggtcctcggcccgcgcactgtgtgacctggaagaacacagctcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306650 - DNA, 608 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306651 - DNA, 702 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaaacaacaaaccaaccctcgaggcggggcccgtacccatttcgccctatagggagtcggataccaatcaatgcccggcgtttaccgtcgggcttgg

SEQ ID NO: 306652 - DNA, 747 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaaacagaactaactaccataccacacaagagaaccaaacaacactctgtgtttccggacgcccctgtggcccctctgaaaaaaacttttcttagaaacccaatttcttgttgggaggacccgggggcccccagtaatggtg

SEQ ID NO: 306653 - DNA, 707 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataccactcgctacccagcccacccctctcctcccaacatgccggccgcttcgcccaatcgacttagactcgccaagctaatccatgcgcccgttcgccc

SEQ ID NO: 306654 - DNA, 537 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaatgactttccttgagtagtttttatctgaaatcaattaaaagtgtatttgttactttaaa

SEQ ID NO: 306655 - DNA, 975 bp, Homo sapiens
agtgaaataggacaacagggagatggtgagtgtgtttcccaactgcagatgacaacaggtctataagcataaagtcatcatataacttaaagaaaccttaccctcggtgaaatctcccacagatcagcaagaaatagactaacaattcggtagaaaaatggggctaggatataaacagttcataggaaaggacacctgatatcattaatgattagggagagaaattgggtagctaacagcaggggtgagagagaaactttatagtattttcctctgtagcttttgaattttaagacatatgaatggattttttttttaattgtaattaaagtataatttttttaaaagagaaattttggagtcatttaacttgtaagacaaaggctatcttgtaataagaatactgttcttcctatttgctctagattttaagtttggattggcatacattggttttcttagggcagaacccactctactagacctatttaaccccatgacagagcctagaaggaacaggtgtaatagaagatggcatttatggcaagaaggttgatcaagttctccattagaatttgaaccagatctaatgccttttcttcccttgtttaagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306656 - DNA, 688 bp, Homo sapiens
  misc_feature (399)..(399): n is a, c, g, or t
  misc_feature (403)..(403): n is a, c, g, or t
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaaaaaaaaaaaaaaaaaaaaaaaaatttgngggnggccttgggcctttggaaaaggttttttagcccattccggtgggcgcgcgcgcgggggcccaagtgtggggcacagtgggcacccagttgggccaataagcgcgtggtccacacagaggggagacaccgcggggcccatgacacacagcgcggcggggatttctctccccaattttaaaaaaaccggccgcgtggggacaccccggagcgggtttcgggaccaaaacccccaagagggaggggcccagagggccaatcacggggcctctattcaaccgcggggcg

SEQ ID NO: 306657 - DNA, 461 bp, Homo sapiens
caggttctgtggatactgtctcctgtaattagtagaatctcaactttattaagtgagaaactgagcctaggagagttacagcagagctgcctggggctctggaggctgcttgtttcctaccatgctacctccctgacacataatcctgtcgattccttacagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306658 - DNA, 664 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaaaaaaagtcgacgcggccgcgaatttagtagtagtagtagtagtagtaggcggccgc

SEQ ID NO: 306659 - DNA, 744 bp, Homo sapiens
  misc_feature (627)..(627): n is a, c, g, or t
  misc_feature (652)..(652): n is a, c, g, or t
  misc_feature (694)..(694): n is a, c, g, or t
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaaaaaaaaacaacaaaaaaanctcgagggggggcccggtaccccanttcgcccaatggggagtcgaataccattccactgcccggcgnttaacaccgtccggactgggaccttgcggtaccccacttttcgccttggg

SEQ ID NO: 306660 - DNA, 881 bp, Homo sapiens
  misc_feature (641)..(641): n is a, c, g, or t
  misc_feature (645)..(645): n is a, c, g, or t
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaaaaaaaaaaaaaaaaaaaaaaaaaaaaaatttgngggnggcggggcccggagaaaggtttttaaaacacctcgggtggggggcggcggggcgccacgtagggaccggggaaccgcgggcacagcgggtcccaagaaacccggggccatacaccaggggggggtgtcccccccataaaacacgcccgggcagaacgcaggcggcgtgggacaaatcccaaagggcgtcagaacgacccgcggcccacacccgcgctcagggagcggaaaaaatag

SEQ ID NO: 306661 - DNA, 694 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcagtgtagacccttgtctgagaccgagctatgtggggcgacctctggctcctcccgcctgcctctgccaatccgggcactgggacagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306662 - DNA, 700 bp, Homo sapiens
ggctgcgaaggtgcagcgggcgggaggcccgttgggggctcagccggctgccagaagctctcgggctctttccttccgtgcccctcacttgctcatgggcccatgcctagccctgattcgttggacagagcctttgtagacccttgtctgagaccgagctatgtggggcgacctctggctcctcccgcctgcctctgccaatccgggcactgggacagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306663 - DNA, 737 bp, Homo sapiens
agggaggggaccaacgggctccggcgctgacaccgcggcactcatgccctgtcccctttcagctgtttccagcatactgtgccccgtctgtcctcaggccagggcttcgctgaagccccggccactccctagtacctggcccggtggtggccaggcagttggccgcgctgcttctcccgcagaggggacccccactgggggcgaaggcttggcctgccctcttcactgctgtatttccagacctgatgcctgcgtttgctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306664 - DNA, 863 bp, Homo sapiens
ggctgcgaaggtgcagcgggcgggaggcccgttgggggctcagccggctgccagaagctctcgggctctttccttccgtgcccctcacttgctcatgggcccatgcctagccctgattcgttggacagagccttgtgagcgggattttccgtttggggatttctaaatctgctgcccaccccgcaactgccggaaagttgcccatggggtggacttcgctgtgtagcgggagaggggtgggagtcgagggtgcttgatggagagatgggggaaggggttgcacggattggaggagcgaggagactcagtccccatcccgaagcacagggcaggacgtcgcggcggagtggggaagcgaggagtccgtggccgagagcttggaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306665 - DNA, 614 bp, Homo sapiens
ggctgcgaaggtgcagcgggcgggaggcccgttgggggctcagccggctgccagaagctctcgggctctttccttccgtgcccctcacttgctcatgggcccatgcctagccctgattcgttggacagagccttgctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306666 - DNA, 579 bp, Homo sapiens
acattcttggatgatatctatgtgcctagatttactcattggtcaatatttcttcttagttgtgcccggagatcttgagcgtcggacaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306667 - DNA, 514 bp, Homo sapiens
  misc_feature (489)..(490): n is a, c, g, or t
  misc_feature (496)..(496): n is a, c, g, or t
  misc_feature (503)..(503): n is a, c, g, or t
  misc_feature (505)..(505): n is a, c, g, or t
  misc_feature (514)..(514): n is a, c, g, or t
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaattaggggctannacgatnactggancntttttttcn

SEQ ID NO: 306668 - DNA, 641 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaaggggcctggtggggcccgggcagggcatgttttcgaagcatggagggagtggttacagggctgggctgggctctgtagactgcagggttggtttggagcatttggacccacctgctctgctcctggtgactttgggttcagatcacagggctcctgccaccca

SEQ ID NO: 306669 - DNA, 541 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaatcccatccagtgaaatccccgtgaatcccacgttgcaccagtgaatccacgtagcgggcaggt

SEQ ID NO: 306670 - DNA, 437 bp, Homo sapiens
caacaaatgaaagaagaggattttgtgttatcacatatactgatgaagagccagtaaaaaaattgttaagtacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306671 - DNA, 719 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcagtgtagacccttgtctgagaccgagctatgtggggcgacctctggctcctcccgcctgcctctgccaatccgggcactgggacagaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaataactttagtgatctgagttcttga

SEQ ID NO: 306672 - DNA, 543 bp, Homo sapiens
agcagggttggggcgagtggaccgcgcctctaaaggcgcttgccagtgcaatctgggcgatcgcttcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306673 - DNA, 1248 bp, Homo sapiens
  misc_feature (1008)..(1008): n is a, c, g, or t
  misc_feature (1012)..(1012): n is a, c, g, or t
agtgaaataggacaacagggagatggtgagtgtgtttcccaactgcagatgacaacaggtctataagcataaagtcatcatataacttaaagaaaccttaccctcggtgaaatctcccacagatcagcaagaaatagactaacaattcggtagaaaaatggggctaggatataaacagttcataggaaaggacacctgatatcattaatgattagggagagaaattgggtagctaacagcaggggtgagagagaaactttatagtattttcctctgtagcttttgaattttaagacatatgaatggattttttttttaattgtaattaaagtataatttttttaaaagagaaattttggagtcatttaacttgtaagacaaaggctatcttgtaataagaatactgttcttcctatttgctctagattttaagtttggattggcatacattggttttcttagggcagaacccactctactagacctatttaaccccatgacagagcctagaaggaacaggtgtaatagaagatggcatttatggcaagaaggttgatcaagttctccattagaatttgaaccagatctaatgccttttcttcccttgtttaagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaaaaaaaaaaaaaaaaaaaaaaaaaaaaaatttgngggnggcggggcccggagaaaggtttttaaaacacctcgggtggggggcggcggggcgccacgtagggaccggggaaccgcgggcacagcgggtcccaagaaacccggggccatacaccaggggggggtgtcccccccataaaacacgcccgggcagaacgcaggcggcgtgggacaaatcccaaagggcgtcagaacgacccgcggcccacacccgcgctcagggagcggaaaaaatag

SEQ ID NO: 306674 - DNA, 628 bp, Homo sapiens
cgggggactgccagcatatacccctttacctggctgtggcaagtctaaatataaataaatatgtcatttatgaatgataataaagagagaatatgattcttactcagcatatactagtttgtgtgggataaatgcactattcaagctagctcctggtcctcgcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaatgccttgtttttttctaataccgtggatggtgggaattcgggaaaataaccagttaaaccagctactcaaggctgctcaccatacggctctaacagattaggggctaaaacgattactgactttccttgagtagtttttatctgaaatcaattaaaagtgtatttgttactttaaa

SEQ ID NO: 306675 - DNA, 618 bp, Homo sapiens
gtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaag

SEQ ID NO: 306676 - DNA, 627 bp, Homo sapiens
  misc_feature (476)..(476): n is a, c, g, or t
gtccatccgatgagacggatgctctgatgctctgaggcttctgggaggctgggccctggaggcaacgtgctgcaggcgcactctgtcagagtgaacagcaccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttttnttttttttttttttcccaaatgggctgttgattttatttgcttgatcaataatgtccttgcaaaaattagttaccaatgctgagacatttgaaatgaattctaattttaaaaaatcatgacacttggttagaatttgagttaccacaacca

SEQ ID NO: 306677 - DNA, 588 bp, Homo sapiens
cagagtccaaacagtgcccagagtccaaacagtgctcagagtccaaacagtgcccagagtccaaacagtgccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaag

SEQ ID NO: 306678 - DNA, 1284 bp, Homo sapiens
cagagtccaaacagtgcccagagtccaaacagtgctcagagtccaaacagtgcccagagtccaaacagtgccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaaggcttctagtttttttgtacacattctttctgtgaggagattgagtactctgcagctggcgaggagttggttgaggcacttcttcaaggccaagggggaacacagtgttttgtttccagctcactttgtacccctcacctctgcagacacggggagaaccccggacccctggcatgcatgctggcggggcatgcctcccttccacaagcccatgctgctgcagagggagcctgtgtttgcaaaacccagtggactgggctgggtctgctgtctgagcaagctcctggctccggtgggaactgcacacaaagtccactggcctggcttggcccaggcattgcaattgaccagacatttgcatttcatacggtaaatgaggaccttcagcacagcaaccataatcagcatgtctgggatagactgctctagaatagaaatgaagtgtccattgcttcgttgcttagcaattcccataatatctgtcatgaaggttaagaaacacgagacacaataccaaaaaaggggcgcgcacaaaattcacggagggcgccaaaacggtacaccttttgacaagggccccacggggcataacactgacgcgaggatcacagatccggaacgcgacggcacgcgaacacctcggcgacgacaccgcactaggcggcactgatggacgccggagagtgaattataaaag

SEQ ID NO: 306679 - DNA, 1234 bp, Homo sapiens
cagagtccaaacagtgcccagagtccaaacagtgctcagagtccaaacagtgcccagagtccaaacagtgccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttgtttgtgtaaactctaatttctatcaaggtgtcatggatttttaaaattagtatttcattacaaatgtctcagcattggttaactaatttttgccaggaccattattgatcaagcaaataaattcaacagccatttgggaaaaaggcagctggcgaggagttggttgaggcacttcttcaaggccaagggggaacacagtgttttgtttccagctcactttgtacccctcacctctgcagacacggggagaaccccggacccctggcatgcatgctggcggggcatgcctcccttccacaagcccatgctgctgcagagggagcctgtgtttgcaaaacccagtggactgggctgggtctgctgtctgagcaagctcctggctccggtgggaactgcacacaaagtccactggcctggcttggcccaggcattgcaattgaccagacatttgcatttcatacggtaaatgaggaccttcagcacagcaaccataatcagcatgtctgggatagactgctctagaatagaaatgaagtgtccattgcttcgttgcttagcaattcccataatatctgtcatgaaggttaagaaacacgagacacaataccaaaaaaggggcgcgcacaaaattcacggagggcgccaaaacggtacaccttttgacaagggccccacggggcataacactgacgcgaggatcacagatccggaacgcgacggcacgcgaacacctcggcgacgacaccgcactaggcggcactgatggacgccggagagtgaattataaaag

SEQ ID NO: 306680 - DNA, 541 bp, Homo sapiens
cagagtccaaacagtgcccagagtccaaacagtgctcagagtccaaacagtgcccagagtccaaacagtgccgcgagacaggccaggctcgtggctcggaagacaaaccccacacacactcaaggggtcgaaaacaaaccccacacgagggctctcacctccttctcctaggtagtatttattttcagcacctgtttgatgcagtttttaatcctctacctattgcactgttgtgactcgttggccattatttgatttttgtacgaaaaaaagctttgttatagaaatcagcatactatttttttaaatctggagagaagatattctggtgactgaaagtatggtcgggtgtcagatataaatgtgcaaatgccttcttgctgtcctgtcggtctcagtacgttcactttatagctgctggcaatatcgaaggttccttttttagtgaaatcatagctaatcaatactatcattttattagtatgagttgagcaaatatccatgcataagtgctagagtgcaacacctttagaaatatcaa

SEQ ID NO: 306681 - DNA, 862 bp, Homo sapiens
cctgagtagctgggactacaggcgcccgccaccacgcctggctaatttttttgtatttttagtagagacggggtttcaccatgttagccaggatgatctcgatatcctgacctcatgatcggctcgcctcggcctcccaaagtgctgggattacaggcatgagccaccgcgcctggcctgaccttgttgatttctatacaaagacatttcagttgcaactattcccttagaacataggcatatagtatagctaccttaagggaatgtaatatgtcaagacctagatttatgaagtaagaataacgagaatcctcacattgcagaagtactcactgcagatttctgtgtgaccacaataatacctgacatgattttctgtgcacactacacttgtatttatattgttcttgacctgtaaaattatggtgcccaggagagaaagttttctcttttcatgcttgccaacatttaaaaaattaaagagttatatatatatgatgctacaaaggatggtgattaacaaaggctttgtgttgctacttagatcatccagcgggaggtattcactatgaaatgtgcatagaatgtccacctactttcagtgacaagagagaacaaatatcagaaaatccaacagaagccacagatattggtaatttgtttaataaataatttttagtaagtagttaacactggcaggaatgagaaaagctcatttgccattgtgaaatgacacttgccaagaataaaacatgattttccaaagttgcttggactagtcatgaaataaatgaaatacttaattctatttcacattgagattaaaaactaaaatagaaaactgcagtataaaaaatctttt

SEQ ID NO: 306682 - DNA, 586 bp, Homo sapiens
cctgccaggtggtggttgtctgaaaatttatttcatttcctttcagtttaatgttagaaattaccctgctggtacctagagtccattttcatccattgttttttaaaataaatgttcttaagctgtctatttaaccttacttacgcttcattagaaaatacctgtgtgtcaaccatacatattttatgaatttttttctcgtagttgatcacagccgagttaaattgacattaaagactccttcacaagattcagactatatcaatgcaaattttataaaggtatgtactaactttaaatggtgtttctctgccatattaatgtctttctacatactagttttgtaaaaactttttgaattgctcaaacatgataccaacagcaaaagaaataaaaataaagccactgccctggcacaatgtttttatatgctttccttctagccttcttattcatatagataaatagtttctacttagttttgtgatagcagagataacattttcttttttatttcttctttcccatggaagtcttacctattactaaattattttctcagttatccctttggacaaaatgaaca

SEQ ID NO: 306683 - DNA, 595 bp, Homo sapiens
taaaatggtgttaaacgcattcaatatttaaataattataaatatatttttaattaatagtgctatttataattaggtaaatatcctaaaagtgatattttaatataatttcagaagtcacaaagtaaatctgtaagatttacatgatttaattcaaaccaaaaacatcatgttaattggaaccaatttaatttgttgctgtatagttagcccttgtttggaaagtctaattttgataatttctttaacttacacatttaatattgaaactacttttttaggcaagccaattatacttctcggtgcaaaattcttgaaatctgtattttattaaaaagtaaaattgtgtttaactgatacgttctttatctcactccccaccatcactttttagatcattgtaatggcctgccgagaatttgagatgggaaggaaaaaatgtgagcgctattggcctttgtatggagaagaccccataacgtttgcaccatttaaaatttcttgtgtaagtatccatttttgtaaacacttttttcagaaaattggcatgctatactgatgaataattaaattataatgtggtatgaacccaggc

SEQ ID NO: 306684 - DNA, 602 bp, Homo sapiens
aacacagctgtatgttccttcatgcagtagcccatgcttttcagtgctcatccagaaacatttactccaaggagaaatagcataacattttaaaattttaagcctaattaaaaaacaattgtttgcttttcctctgatgctgaaaatgataggccttgatttcttgggatatatacccataacagacccagctttctattatttgtatataaaatgaatgtattgtaataggtattaaatgtcttcctcgtagggcttgataacctctgaaaatgagaaatgtgatcatccagcgggaggtattcactatgaaatgtgcatagaatgtccacctactttcagtgacaagagagaacaaatatcagaaaatccaacagaagccacagatattggtaatttgtttaataaataatttttagtaagtagttaacactggcaggaatgagaaaagctcatttgccattgtgaaatgacacttgccaagaataaaacatgattttccaaagttgcttggactagtcatgaaataaatgaaatacttaattctatttcacattgagattaaaaactaaaatagaaaactgcagtataaaaaatctttt

SEQ ID NO: 306685 - DNA, 3922 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306686 - DNA, 3844 bp, Homo sapiens
cccgtggggagaggcggctgcggctgcggctgcggctgctggcggggggtgggggggaggaggaaccgggaagggggggcagggcgagcggagagctagctgtgttcctgaggcgcagccgccgcctagggcggtggggaggaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306687 - DNA, 3506 bp, Homo sapiens
aggagtgcagatcgtggctgacagaggaacgggggtattgagcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306688 - DNA, 3845 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306689 - DNA, 3885 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306690 - DNA, 3918 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgctggacctggtggcacgcatctgtaattccagctactcaggaggctgaggcacaagaattgcttgaacctgggaagccgaggttgcagtgggccgagatcgcaccactgcactccagcctgggcaacagagtgagatcctgtctcaaaacaaacaaacaaagtgctgtgcggttaagaagattgtctaccaaatatagaacagaaaagatatatcccacagccactggagaaaaagaagaaaatgttaaaaagaacagatacaaggacatactgccatatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306691 - DNA, 3576 bp, Homo sapiens
taaaatggtgttaaacgcattcaatatttaaataattataaatatatttttaattaatagtgctatttataattaggtaaatatcctaaaagtgatattttaatataatttcagaagtcacaaagtaaatctgtaagatttacatgatttaattcaaaccaaaaacatcatgttaattggaaccaatttaatttgttgctgtatagttagcccttgtttggaaagtctaattttgataatttctttaacttacacatttaatattgaaactacttttttaggcaagccaattatacttctcggtgcaaaattcttgaaatctgtattttattaaaaagtaaaattgtgtttaactgatacgttctttatctcactccccaccatcactttttagatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306692 - DNA, 3977 bp, Homo sapiens
  misc_feature (2275)..(2275): n is a, c, g, or t
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccaggaattatacactcaatattatacaaacgacgcgaggtggccacacgtattcgttggctngccaactagttacctgaatgaggcgattctcggtaacgttacgagaaaacgtgatttgctcatactgatccgagtatgtctagaacagtaaactactagtcatggaactaacagcacttcagcgtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306693 - DNA, 3868 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatacttgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306694 - DNA, 3946 bp, Homo sapiens
  misc_feature (3187)..(3187): n is a, c, g, or t
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctaaaactncagggcaaataatttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306695 - DNA, 3248 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgctcagcgctagcgctgagccataccgccgaacgccgggggcctctgtaaggcacatggaggtgatggtgtttcttagagagaagatcactgaagaaacttctgctttaatgactttaccaagctggccatattaccatccttgacctcggtgaaagcagtcatcttcagcgttttccagccctatagccaccccagtgtggttatcctcctcgattgctcagcgct

SEQ ID NO: 306696 - DNA, 1674 bp, Homo sapiens
aacacagctgtatgttccttcatgcagtagcccatgcttttcagtgctcatccagaaacatttactccaaggagaaatagcataacattttaaaattttaagcctaattaaaaaacaattgtttgcttttcctctgatgctgaaaatgataggccttgatttcttgggatatatacccataacagacccagctttctattatttgtatataaaatgaatgtattgtaataggtattaaatgtcttcctcgtagggcttgataacctctgaaaatgagaaatgtgatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306697 - DNA, 1934 bp, Homo sapiens
cctgagtagctgggactacaggcgcccgccaccacgcctggctaatttttttgtatttttagtagagacggggtttcaccatgttagccaggatgatctcgatatcctgacctcatgatcggctcgcctcggcctcccaaagtgctgggattacaggcatgagccaccgcgcctggcctgaccttgttgatttctatacaaagacatttcagttgcaactattcccttagaacataggcatatagtatagctaccttaagggaatgtaatatgtcaagacctagatttatgaagtaagaataacgagaatcctcacattgcagaagtactcactgcagatttctgtgtgaccacaataatacctgacatgattttctgtgcacactacacttgtatttatattgttcttgacctgtaaaattatggtgcccaggagagaaagttttctcttttcatgcttgccaacatttaaaaaattaaagagttatatatatatgatgctacaaaggatggtgattaacaaaggctttgtgttgctacttagatcatccagcgggaggtattcactatgaaatgtgcatagaatgtccacctactttcagtgacaagagagaacaaatatcagaaaatccaacagaagccacagatattggttttggtaatcgatgtggaaaacccaaaggaccaagagatccaccttcagaatggacatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306698 - DNA, 1334 bp, Homo sapiens
tgattgcatttagacctagaatggtttatatcgggatcgcgatgtctaaatgcaatcatgattgcatttagactcaatttccaaaataattttcacccctgattgcatttatgattcagggagctagaagacactttaagttatactggaaaattcaggtgccactgaaagccagatttatagtattccatctttaatatgtgggactaacagcagtgtagattgttaccttaatattttttgctgggaccatctacctgccttatactacacttaggaaaaagtattacatatggtttattttgaaacttcaagtattattgccttaatgtctcttaaccctgttacacgctgcttgtagacatgttaatatagtaatacctttatgatatattgagtttaaggactactctttttctgttttatcatgtatgcattattttgtatatgtacagggcaagtaggtatataatttgataaagttgcaattgaaatattattaacagaagatgtaagaaatttctgcatggtctaaatctttgtgtactttatttgtaaattatttgccctggagttttagaaaatagtttctgaattttaaacttgctggattcatgcagccagctttgcaggttatcagagatcaaagattgtaataataattttgtaaattgtaagcaaaaagttatttttatattatatacagtctaattgttcatcctaattgttcctgttttcatctagtcagagattcagtaagtgccttggaacaatattgaattctcttagcttgtgtgtgtttctttaatatttgaactcaagtgggattagaagactatcaaaatacatgtatgtttcaggatatttgacctgtcattaaaaaaaacaaacagttttacagtgttcgtgccgaattcggcacgagtcacactgctttcaagctggactgagccagtttcattttgggaaagaaacgctgtgtccagaactcagcagctccatttattttttccagtcgaaagaaactgatctttaggcagtttttacttggccagaaagcagtgctgaatacttgaaactgtgtggtctgttctacttaatgttctgtcagaatgttcttttgtaggcagtatgtcatgatgtaatcatctatctccttgtctgtttccaagttacactgtgaagtttgcgacccttttaaggtggtcatcaaagacacagattccttgtttaaccaagtgtcccaaagcatgtacctgaagttatatcattttttattttaaaaagatatgcagcttatattttgaaaactattaaaacatatgcccctgtta

SEQ ID NO: 306699 - DNA, 2571 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaagatgttgatgttagtgaagattcacctcctcccctacctgaaagaactcctgaatcgtttgtgttagcaagtgaacataatacacctgtaagatcggaatggagtgaacttcaaagtcaggaacgatctgaacaaaaaaagtctgaaggcttgataacctctgaaaatgagaaatgtgatcagcagcaggagtatccgcggcgctctcgagacgccc

SEQ ID NO: 306700 - DNA, 2527 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccatacccatacctgatttatctgaaggcaattcctcagatatcaactatcaaactaggaaaactgtgagtttaacaccaagtcctacaacacaagttgaaacacctgatcttgtggatcatgataacacttcaccactcttcagaacacccctcagttttactaatccacttcactctgatgactcagactcagatgaaagaaactctgatggtgctgtgacccagaataaaactaatatttcaacagcaagtgccacagtttctgctgccactagtactgaaagcatttctactaggaaagtattgccaatgtccattgctagacataatatagcaggaacaacacattcaggtgctgaaaaaggtaataatatagtgtcaaatacttaaatgtctttcctatgtgctagtcactgttttaagcactttagctgtattgatttattatgttttattccacactctaccatagaacctacagcaaaatctgtcttagatactaattttttaatataagcttttaatgtattgttaac

SEQ ID NO: 306701 - DNA, 2048 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggaatttaatgtatttaatttaatacaagaaatgagaacacaaaggcattctgcagtacaaacaaaggagcaatatgaacttgttcatagagctattgcccaactgtttgaaaaacagctacaactatatgaaattcatggagctcagaaaattgctgatggagtgaatgaaattaacactgaaaacatgatcagctccatagagcctgaaaaacaagattctcctcctccaaaaccaccaaggacccgcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttgcctcttgatgagaaaggacatgtaacgtggtcatttcatggacctgaaaatgccataactattaaaccccttgtttacagacaaatgaaataaatttattccacccaaata

SEQ ID NO: 306702 - DNA, 1691 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaaggaaaaaatgtgagcgctattggcctttgtatggagaagaccccataacgtttgcaccatttaaaatttcttgtgaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcaggtacaaaagaatttcccaagtttataaatacattatttaagtttgatgttacacaaggttttatttctgcattaatatgttagtaatcttgaatttctcctagccttgatacaatgtttgggactagggccttgtaagttgatgtggtctcatttggttgacagaccgtttagagtattgttgcattaaaacacaggatcatctatttgaaaatagtattcacatggtgggaagctatagaacatactctttttactgttcactgattagagcatataatctcagatcctcatcatactctactttctaaagtcagtatggtagtattttcttttaatcaatttccctgaaacaatgaccaagcaattttcattcctgataaacactgacatgagatttttaaaaacaggatattgctctgatgcccaggttggagtgcagtggcacaatcatagcttactgtaaactcaaactcctggcctgacgtgatccttctgcctcagcttcccaagtagctaggactacaggcatgtgctaccacactgaactaattttttttaattaaaaaaaattttttttaagagaccaagtcttgctctgttgcccaggctgatccgaactcctgtcctcaagtgat

SEQ ID NO: 306703 - DNA, 1282 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaagggcgtctatgggccaaaagcatatgtagcaactcaaggacctttagcaaatacagtaatagatttttggaggatgatatgggagtataatgttgtgatcattgtaatggcctgccgagaatttgagatgggaagggaggatgaacaagcaagaacagactacttcatcaggacactcttacttgaatttcaaaatgaatctcgtaggctgtatcagtttcattatgtgaactggccagaccatgatgttccttcatcatttgattctattctggacatgataagcttaatgaggaaatatcaagaacatgaagatgttcctatttgtattcattgcagtgcaggctgtggaagaacaggtgccatttgtgccatagattatacgtggaatttactaaaagctgggaaaataccagaggatttactgtctttaattcagtacaggaatgggaacacaagggttctggaggacgaacaagggcatatgattgtcatagagtaatgcatgttgaaaaaggtaattttgaatcgggggcgaatgggagggggaggataccggagggtgcatagagggaaaaggtcttcaaacaggcggggtggagggtagaaaggcggaagggggggtccataagggggaag

SEQ ID NO: 306704 - DNA, 949 bp, Homo sapiens
catctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggagggagccgcggggcttggcggggtcgggagggagggacgtgctgggggaacgagctggggaagacggagcgggctctgtgccgggcgggcgggcggcgggggggccagcgaccgcagccggggggacgcgggaggatggagcaagtggagatcctgaggaaattcatccagagggtccaggccatgaagagtcctgaccacaatggggaggacaacttcgcccgggacttcatgcggttaagaagattgtctaccaaatatagaacagaaaagatatatcccacagccactggagaaaaagaagaaaatgttaaaaagaacagatacaaggacatactgccatttgatcacagccgagttaaattgacattaaagactccttcacaagattcagactatatcaatgcaaattttataaaggtatgtactaactttaaatggtgtttctctgccatattaatgtctttctacatactagttttgtaaaaactttttgaattgctcaaacatgataccaacagcaaaagaaataaaaataaagccactgccctggcacaatgtttttatatgctttccttctagccttcttattcatatagataaatagtttctacttagttttgtgatagcagagataacattttcttttttatttcttctttcccatggaagtcttacctattactaaattattttctcagttatccctttggacaaaatgaaca

SEQ ID NO: 306705 - DNA, 985 bp, Homo sapiens
aatgaatactactctaacctactctaacatggtgcttacggtatattgctcatccatttaatagtgtagattagttaaatagtatatatagtgttatgtttacagtacatgctctggaagtagaactgcctggtttagagcccacacttgtcacttcttaggaaagtttgggcaagttattttatctgtatatctcagttataaaatgaggatggtattaacagtactttcctcatggaaattaaattgttacatgtgaagcccttaggtatttggcatgtgtttaacagtcaataagtgttggctattatttatttgggtttttttaaaagcagtgctaaatgccacacaaatttcttagaaatggcagtttaaatgagctgtgcaactttaaactttgcaaagtattttcataattgttgactttctgtttttcttgaaggaatctcgtaggctgtatcagtttcattatgtgaactggccagaccatgatgttccttcatcatttgattctattctggacatgataagcttaatgaggaaatatcaagaacatgaagatgttcctatttgtattcattgcaggtacaaaagaatttcccaagtttataaatacattatttaagtttgatgttacacaaggttttatttctgcattaatatgttagtaatcttgaatttctcctagccttgatacaatgtttgggactagggccttgtaagttgatgtggtctcatttggttgacagaccgtttagagtattgttgcattaaaacacaggatcatctatttgaaaatagtattcacatggtgggaagctatagaacatactctttttactgttcactgattagagcatataatctcagatcctcatcatactctactttctaaagtcagtatggtagtattttcttttaatcaatttccctgaaacaatgaccaagcaattttcattcctgataaacactgacatgagatttt

SEQ ID NO: 306706 - DNA, 481 bp, Homo sapiens
gctgacttctctactgaagattcccttcaggcttggagaactgaatgatgtctgtagagtgacaggaaagtcatgggagagagtcatttctgtatacattatctttgctcaataagcatcataattcttgataatgagtggaaaaggtttcttgcatttttttgcatttttaaaaactgatctagatatttgtgacaggaatttttagaatgtcaagaaagctctctgattttgtttagatgacatgttaatttgtctaaatttttatgtgtttaatttagatgttgatgttagtgaagattcacctcctcccctacctgaaagaactcctgaatcgtttgtgttagcaagtgaacatagtgagtgtctcttttgcttttacatttacttcatattctaataataaactccgaaaaacatacctgattttaatctattagctattgtgctacataattaaattcaaaaacaagtaaattga

SEQ ID NO: 306707 - DNA, 1349 bp, Homo sapiens
ggtcctttctcccttcgtgtgcactaggaatccaaagctaatctgtccctgatccggattgcacgcacctgtgccttttggggcccttctgcattagttcttccttctcttctaacctcaaaaatgtgttttttctattggctctttccctttaacatagaagtatactcacgcttttgttgaatcttgaaataaaagtcttcctttaccacatatctccctttaatactacatctctcttctcagccaaatacttgggaagagaagccctgagtttgtgtcattgttttctcacctccagttcactactttgcccactgcctgacatccagctcactcacacacacacacaagcccaatcactaagttgccatagctaatttgtagctttcctgccttcctggcaaaatttgactctgcattgggataatacatgtcgagtacctattgaacaggcactgtgctaggtgctactgttatagatatgaaaagaaggcatcatctcctttctaacaactcacaggagcagccattcctgattcatacatgtctcttgactcccagtgctcactttttcaagcttcacttaatgccgtgcaaatcaccctattctccaggtcttctttcttcccagttctccttactatacacaacttctcaaggcagtcacctccacacccatggcttcaattgctttctccattctctgagaacaatagaattttaaatggttttatttcatgtattagctttattttatacaaggtgcctcacctgctgtaaccatagattcaaagttgctccatgaaagtaataaatgaaaaatggtgattttttagcatgtaaattttaggaaatttccccagttacgcttaatggcttgatttagtgtgtatgttatttttgaaaacatatgttgggatgtcacaaatggacttagcctacagagatttatattcaacttttgaccagagagttccattttaatgtgacactgagagttaaaaaactatcttttcctccttacctatttctcttcctacattctcggccaggaggaaggcactgctacatacccagtcttccccagcagagcctgagcagctctgttttccttctacttcccctcttctttcacatctcatgaccaagcacttcctattctgtctcccaaatgatcacagactttttcctccacttttgtcactgccactgcccttagcattactctgcctttagagaaagtctcttaattggtttgggttgcttccttcagtctttattatacagaccactacacgcacatctgacagagacttttcacctttttatggttgaatgactgaaat

SEQ ID NO: 306708 - DNA, 885 bp, Homo sapiens
ggcggggcctgagccaatgcagaagcgggggccgcgaggacgccagcgggcgctgtgcgtaggaaccgccgggtggccgctgccgatcggggccgacttggggacggaccggaagtgcccgagggcggccgcagaacggtcaatttgagccgcgtcgagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccataaaaaaaaactcagggctctag

SEQ ID NO: 306709 - DNA, 576 bp, Homo sapiens
cggccgcgagcctccggcccaggtaaccgctggggcggcagccgcctttgttggcggcgagtcgggcccgcaccgcccccgcctagaccccgaccccagcccctgccccgaccccagcctcggcgccattccctagccagcccatgcccctgacccggggcctccccgcccgccagtgcgctggatcccgagacggcgggacgcgaagagcctttgtggacgtgggaagcgtttcagtgtttggttctgcgtggggagtcccacgttactcgatgactttcggccgcgaaggctttgaatggtgcgtttgaaaatacggaaactttcttctactctaggtggccatggctaccgggcaggtgttgttccagcggttcttttataccaagtcttttataccagcaccaatgagaaaccagctgtgtggtggggtttccagagaagaggaaattccttctttcctggagagcgtgcagctgtaactcacagacgagacatccctgagctaccagcccgtggtcctgtactagtcctggcaaaggttccggtaactgcagcaacagatacctcctgccc

SEQ ID NO: 306710 - DNA, 1080 bp, Homo sapiens
  misc_feature (869)..(869): n is a, c, g, or t
ggcggggcctgagccaatgcagaagcgggggccgcgaggacgccagcgggcgctgtgcgtaggaaccgccgggtggccgctgccgatcggggccgacttggggacggaccggaagtgcccgagggcggccgcagaacggtcaatttgagccgcgtcgagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccaaaaacanaaatgaacaaaagtactacttagtaacatacaacagcagagcaacgaacagccggcgcagggacatattattgggggggcgggagaaacagagtgtgataaacagagcagcaggtgtataaagatgtttacagcgaccccggtttgttgaacaagggggaatattgcgggccccccaagaggggagagcaatcttgaaagggggtaccgta

SEQ ID NO: 306711 - DNA, 861 bp, Homo sapiens
ggcggggcctgagccaatgcagaagcgggggccgcgaggacgccagcgggcgctgtgcgtaggaaccgccgggtggccgctgccgatcggggccgacttggggacggaccggaagtgcccgagggcggccgcagaacggtcaatttgagccgcgtcgagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306712 - DNA, 4261 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306713 - DNA, 4208 bp, Homo sapiens
  misc_feature (3340)..(3344): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttagtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306714 - DNA, 4937 bp, Homo sapiens
  misc_feature (4069)..(4073): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggcctggagtgcagtggcgctatctgggatcactgcaagctccgcctaccagattctggtgattcttgtgcctcagcctcccaagtagctgggattgcaggcgcccaccaccacgctcaggtaatttgtgtgtgagtgtgtgtctatgtatatatatatatagagagagagagagagacacacactcacatgttttggggtttttttgttttgttttgtttttcttgagacagagtctcgctgtgttgccaggtgagtactgtggcgtgatctcggctcactgtaacctccgcctcctgggtccaagcgattcttctgcttcagcctctggagtagctgggactacaggcgcgtgccaccaagcccagctaatttttgtagttttagtagagatggggtttcaccatgttgggcaggatggtctcaatgtattgactttgtgatccgccctcctcggcctcccgaagtgctgggctcacaggcgtgagcccccgcgtccagccccatctgcatttctgtgatgtctgtgtaagttctgggtcccagctgggagccggaagttacagtctgcttgcgtcgctgtttgacctgtagaggggccttatctcgctctacgaacttgtttcttattgggagagtgttttgtggttggcttttaacctcttgttctgattctagtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306715 - DNA, 4465 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcggcgtccgagcgcgacaccgcccgcgtcgggggcttgggagcctcggggcgcgagctgtgttggaagcaaagtcctccttgtgggttggggtggcggagggagaagggaagcgagggtcgcggcgggaccagacgccccagtcccggcccgcccgcgactactgaaggcgctgccgcctgacctgaacgggcacttgtgttccagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306716 - DNA, 4520 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggtaggaagccccgcgggggcggatgggaggatgcacacctggttaggagtgcgggtctcagcagctccgctggggcagggccggtggccacacacacactctttcccctctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306717 - DNA, 4724 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcggcgtccgagcgcgacaccgcccgcgtcgggggcttgggagcctcggggcgcgagctgtgttggaagcaaagtcctccttgtgggttggggtggcggagggagaagggaagcgagggtcgcggcgggaccagacgccccagtcccggcccgcccgcgactactgaaggcgctgccgcctgacctgaacgggcacttgtgttccagctcccctgggacctgtggccgccgcccacagaccatgctcctggggcgcctgacttcccagctgttgagggccgttccttgggcaggtaggaagccccgcgggggcggatgggaggatgcacacctggttaggagtgcgggtctcagcagctccgctggggcagggccggtggccacacacacactctttcccctctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306718 - DNA, 4610 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcggcgtccgagcgcgacaccgcccgcgtcgggggcttgggagcctcggggcgcgagctgtgttggaagcaaagtcctccttgtgggttggggtggcggagggagaagggaagcgagggtcgcggcgggaccagacgccccagtcccggcccgcccgcgactactgaaggcgctgccgcctgacctgaacgggcacttgtgttccagctcccctgggacctgtggccgccgcccacagaccatgctcctggggcgcctgacttcccagctgttgagggccgttccttgggcagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306719 - DNA, 4183 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagaggctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306720 - DNA, 4175 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306721 - DNA, 4285 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccataaaaaaaaactcagggctctag

SEQ ID NO: 306722 - DNA, 4445 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccaaaaaaaaaaaaaaaaaaaaaaaaaaaaaaaaaaaaaaaaaagccgggggatttatattgttgggggggggaaaagagagaggttaagtgaaaggggccaagtgggccaaagggtgtgttccctgtgaccccaagtttttctgtgtgttccaaagagggggaaaattttgccgggttcccctta

SEQ ID NO: 306723 - DNA, 4570 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccttaaaaaaaaaaaaaaaaaaaacacgctcgggcgacatatatgcggggggcgagaaagaaagtccatgcacgggcccggggtcaactggagggtcctggacccaggttccttgggcacacggggaaactggccggctcccatacgggggcgaataattcgatagccggttacctggttgcctcgcggcgcaagacataatacaacaagcaagcaactcgagccaaacagacgacaacacggcaacgtaaccctcaccaccctcgcacagaccctccagcacgaccgacaaactcacagacacgcagcga

SEQ ID NO: 306724 - DNA, 4939 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcccctttcctgcgggtctggagctccaaaaaaaaaaaaaaaaaaaaaaaaaaaaaaaaaaaaaaaaaactcccgagagggcatcatagtggacgcgggggcgcggagaaaaagcgggtgatgagaaatgggcgtcctgtgggcacaaagcggtgtgttcctgtggacccaaacggtttctttgggaccacaggggggaaaaatcccgcgcgcggcgtcccccataagaggagagggaggttaaaaatttttgcgagaaaagcgcgcggtggtgaaccccgtggtgtttaatgaatttttgggtagaaaatagtgtagaaaagagaaaaagaaagaagaggaaggaggaaggatgaaggaaagaggaggatgaaaagaagtttataagaaagaaaaaagcaagggggggcagaaagagaaaaccgagatgtaacacacagagggacgaaagacgatacgaagacaacaagatagcgaacacaaacaaaagagaaaaggaaaggacgcagaagagagaaagaaaagaaaaaatttacaccaaaaagtaggcaaagggagaaggaaagagagagacgggaggagagagggaagcagtaggagcagagacaggaagcaagagggacagacagcacgacaggaaaagggcgaagcgcagacgaaaagagtgagaagaggagggaa

SEQ ID NO: 306725 - DNA, 4470 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcccctttcctgcgggtctggagctccaaaaaaaaaaaaaaaaaaaaaaaaaaaaaaaaaaaaaaaaaaagccgggggatttatattgttgggggggggaaaagagagaggttaagtgaaaggggccaagtgggccaaagggtgtgttccctgtgaccccaagtttttctgtgtgttccaaagagggggaaaattttgccgggttcccctta

SEQ ID NO: 306726 - DNA, 2533 bp, Homo sapiens
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306727 - DNA, 2557 bp, Homo sapiens
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccataaaaaaaaactcagggctctag

SEQ ID NO: 306728 - DNA, 4195 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctcccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306729 - DNA, 4320 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcggcgtccgagcgcgacaccgcccgcgtcgggggcttgggagcctcggggcgcgagctgtgttggaagcaaagtcctccttgtgggttggggtggcggagggagaagggaagcgagggtcgcggcgggaccagacgccccagtcccggcccgcccgcgactactgaaggcgctgccgcctgacctgaacgggcacttgtgttccagctcccctgggacctgtggccgccgcccacagaccatgctcctggggcgcctgacttcccactggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306730 - DNA, 4450 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggtaggaagccccgcgggggcggatgggaggatgcacacctggttaggagtgcgggtctcagcagctccgctggggcagggccggtggccacacacacactctttcccctctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagaaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306731 - DNA, 4384 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggtaggaagccccgcgggggcggatgggaggatgcacacctggttaggagtgcgggtctcagcagctccgctggggcagggccggtggccacacacacactctttcccctctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagatagggggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306732 - DNA, 4347 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggtaggaagccccgcgggggcggatgggaggatgcacacctggttaggagtgcgggtctcagcagctccgctggggcagggccggtggccacacacacactctttcccctctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccataaaaaaaaactcagggctctag

SEQ ID NO: 306733 - DNA, 4229 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggtaggaagccccgcgggggcggatgggaggatgcacacctggttaggagtgcgggtctcagcagctccgctggggcagggccggtggccacacacacactctttcccctctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagatagggggcccgttgctgctgtgatccgtagtaataaattctcagaggactcagcc

SEQ ID NO: 306734 - DNA, 4292 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggtaggaagccccgcgggggcggatgggaggatgcacacctggttaggagtgcgggtctcagcagctccgctggggcagggccggtggccacacacacactctttcccctctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggccgaaggctggcagacccccaagatctacctgcggggcaaatgagtctggcgccgcccttcccgcccgttgctgctgtgatccgtagtaataaattctcagaggactcagcc

SEQ ID NO: 306735 - DNA, 3899 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnntcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcc

SEQ ID NO: 306736 - DNA, 2571 bp, Homo sapiens
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcagga

SEQ ID NO: 306737 - DNA, 2359 bp, Homo sapiens
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagtta

SEQ ID NO: 306738 - DNA, 3356 bp, Homo sapiens
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggcca

SEQ ID NO: 306739 - DNA, 3581 bp, Homo sapiens
  misc_feature (3393)..(3397): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccaaaaaaaaaaaaaaaaaaaaaaaaaaaaaaaaaaaaannnnnaaaaaaaaaaaaaaaaaaaaaaaaaaaaaaaaaaaaaaaaaagccgggggatttatattgttgggggggggaaaagagagaggttaagtgaaaggggccaagtgggccaaagggtgtgttccctgtgaccccaagtttttctgtgtgttccaaagagggggaaaattttgccgggttcccctta

SEQ ID NO: 306740 - DNA, 3498 bp, Homo sapiens
  misc_feature (3498)..(3498): n is a, c, g, or t
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccactcaggacatccggagcgttatggacgtggtaggtggtcgttctgtgtgcttgtgaaagtgtccaggcgtgtgcacagccagtgcgcccacttccgggctccttgctccctgctgtactgaagttttggattttgcatccaatcctgtgtgcctgcccttctgccgaaggcttgtgaggggcctgagtcctctgcccatcaggatgacaggctccttcctgcagggccataggagggaagttttggaaacacagaatgattccaaggtgctctcgttcctgagggggactggtttgtaacccatgacatctgtgggcgagagaggcagctgggagcaggacacttggagggtcaccccacgggggtggcacctgcactctgagtgccccccactgtcatcagctgcctcttaccgtggacacagttttggttttggggactagggggccccactcctggtggtaccgtttggacttactagggcagtgggacatataggccggggctagtgggataacggggagttacgcctgatgacttttttgatggaatcctgcattagatagctggtgggacccccccctcagaattggggaactgaggagactccagggagggtgtccttccagggagagcagctatgaggggccccctagcttcctgtgcctggaagtaagagaaccagtaaagggccatacacacctgtacccaagagaccgctctccatttgctttctttttttactaaataattgtaaaatattattatgacataaagaaccatttaaggccacacaaaaaaaaatcacaacaaacttgacccctcttttctcctaccgtccactctccctctcttctggccccttcccctctaccctctatcatcatatctctccctccccctttctctgttcgcccccccccctttcctctcn

SEQ ID NO: 306741 - DNA, 1247 bp, Homo sapiens
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatggtgagttgagcttccttgttttatgagaccagcaagggcagtgcaggaatgtgttgacttgaggcacttgggcagtgggtaggcagcccagtgacttggttgtgggctggagttgtccgagtgcccagtgctcctgctgtataaattccaatcagactcccaaaatgggcactggcagtcacggtaggtggcccgtcccctccctgcaagcctggacttcctgtgtcccccaccctgaagagagcagtcagtgggcttcctctgggagctgttgacttggcgcagggggaccttttcctggggagggtggagggac

SEQ ID NO: 306742 - DNA, 1169 bp, Homo sapiens
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagtgagtcagtcagagctgtctagtctatcatagatgcctattttctttatttctgattaagttacagtaaggcttgtataacacaatacaggcctgaggctctaaacctgtgggatattcatgagcgcagtctcaagctccaccaacagagcctgctctgaggcatcagtagatgctgtttagtaagggcaggggctccagtgaggacagtgcgctgtggcgggtcgcgctggggctggcttcctgctttacccatgtcagtgcacggccctgctgctgcttctgtcccacaagtttctgagtgctctggagcagggaatcttaatctcagcactattgacattcaggctggataatcttttttttcctcctgagacaggtttcctgttgtccagggcagagtgcggtggtatgcatctcggca

SEQ ID NO: 306743 - DNA, 1252 bp, Homo sapiens
gggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagagaccgacctccgcgtggtgggctgcgagctcatccaggcggccggtatcctgctccgcctgccgcaggtggccatggctaccgggcaggtgttgttccagcggttcttttataccaagtccttcgtgaagcactccatggaggtaaggcttcctcctgcacttcattcccagcgaagtatgttgagggtaaaacggtttgttactttgcccggttactaagggagtgagtacttgccccccagtctgagctctgtgccggagggttctgtttcttgactttttttttcccctgggtgcacctcccttttggtctgaatagccctcaagcctttggcggccgtcaggacgccgtggctggggacaaacatgggcgtgttgcaatgcttccgcttcagcatgtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataaggtgggtgtgcggctcctgccctgcgagcccgcctaggccgctgctcctgcctggccgcctctctccacctcagtgcagttgaaggctctgaagaggactgagtgcatccctgacttggctttccagtttctatttataatctcaagaatagttcctgacgtattcgtcttctagtgtcagctgtttattttagtaacacatttttaagtgttttggaaatggtattatttaagtttgggctttcaaaaatagtggtgagtttataaatgttgaattttagtttatgttttcctttctctacagttaatttttttttgttttctttttttttgagatggagtttcgctctatcgccaggctggagtgcagtggcatggtggcagtgg

SEQ ID NO: 306744 - DNA, 485 bp, Homo sapiens
gcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcaggtgagtggccccctgcttggccctgggagggcaaagtgc

SEQ ID NO: 306745 - DNA, 450 bp, Homo sapiens
ttttgtttggagcaactgaagaagaaattcaggaaatctgcttaaagatcttgcagctttatgctcggaaaaaggttcttcggcattttttcatgtaacgtatgcgtttgtgtttggccagaaacacctggttctgaacggacaccttctggcttttgcaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctgggtgagtctgttagagtgcaggaatccactccccacaaaggcaaagactggtgactctcccccgcctccattctggggtatgtgctccttccagacattttttttttttttttttttgagacagggtctctgtcacccaggctggagt

SEQ ID NO: 306746 - DNA, 1179 bp, Homo sapiens
agcggagtgactgaggcggccaagcggctccgggacagggggtacggggggtgggggcgggtggttgcctgcgggaggccgccgcgggtcatgtgaccggaagggctcctcacggacgccgtccctcctcggcgcggcctgagcgcccggcccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 306747 - DNA, 540 bp, Homo sapiens
tgaagagaggagaagagctgtccaaggacccctctcttcatgggatcccaaactgtacaaccagccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 306748 - DNA, 473 bp, Homo sapiens
gcaacatatatcaccaaagccagtgaccagtcgcaggtgggtgtggagtttgaggccagcacaaggatgcaggacaccagcgtctctttcgggtaccagctggacctgcccaaggccaacctcctcttcaaaggctctgtggatagcaactggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 306749 - DNA, 783 bp, Homo sapiens
agcggagtgactgaggcggccaagcggctccgggacagggggtacggggggtgggggcgggtggttgcctgcgggaggccgccgcgggtcatgtgaccggaagggctcctcacggacgccgtccctcctcggcgcggcctgagcgcccggcccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagacatacagggcatcacactgaaaaggagctgtgatctgagggtcaggagtgtgggcctgggtaccagcactgccactgacttgcctctctctcagccttagttgccccttcactgaagacctttccagctttggtgatctacgattctatcacagcaagcaacaggaagacagagcatcatgctaggcacataagaagcttttaaaatactggttaaattgagatcaccacaccaggggaatagtgtccaagtcatgctccagctcctttcccctcttagggatcttggactagaaaaggccaaactttgtttatttcttaaaacttgaatctgagttcacagaaaaaaaaaaa

SEQ ID NO: 306750 - DNA, 1439 bp, Homo sapiens
agcggagtgactgaggcggccaagcggctccgggacagggggtacggggggtgggggcgggtggttgcctgcgggaggccgccgcgggtcatgtgaccggaagggctcctcacggacgccgtccctcctcggcgcggcctgagcgcccggcccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatccaaaaaaaaaaaacatctcattatgaggtccgtaatcaccaaattcacactgggcccgatcgcttttacccaaactgttcgtggaactgtgtgaaaaatccactggtcgggtaaacctccaaactttaaaattggcccttggtcagactaaaattcccccctctttccgcctcagcttgggcgtaaaataaatctaaaataagggcccctgaacccggaattggcccttttctcagatcagcttggcttcgcttggtggtcg

SEQ ID NO: 306751 - DNA, 1410 bp, Homo sapiens
agcggagtgactgaggcggccaagcggctccgggacagggggtacggggggtgggggcgggtggttgcctgcgggaggccgccgcgggtcatgtgaccggaagggctcctcacggacgccgtccctcctcggcgcggcctgagcgcccggcccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatccaaaaaaaaaaaaattactacttcctctctttttctcttattctattttcttctcttcttaaaaaaaaaaaaaactttgggggggggccccgtcccccaattcgcccttatggtgagtcgttatacaatccattggccgccgtttacaaactttttgacttggaaaaatcttggcgttcaccatcttaaatcgcttgaacaacattcccttttcgccagttggcgaaaaagcg

SEQ ID NO: 306752 - DNA, 1063 bp, Homo sapiens
tgtgggcaggggagctgcggcctgcagcaggaaagactgaggaactgagataggcctggaggggagcattgaggagtctggcactgaaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 306753 - DNA, 1431 bp, Homo sapiens
tggtgatctagcaggatccttagctctggaaaaggggatgaggaaggctgttcttgggctcttgacttgcactgatttcccctttagatcccagtgcttgctatgtctcagctcctctgtcttccagcctctagtatcctttctttgccaggtcctagaatgtttttcaagctccagggctgttgctgactacctgctttgtgcctctgtccattttttcagggcctctaggactgcctggttccactctcatttatcctagaacaccaactcagttgagctcccaaggataggcaggaactgagtcttatctggcattccataaagctgggcactttagatattccttatagaaacatttttggtgtttaaggtcagagctgggctaagggtagcacccgtgaaaggcaggatctacgggtcctggggctgacttctctcccatgaccacttctaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 306754 - DNA, 1191 bp, Homo sapiens
  misc_feature (31)..(31): n is a, c, g, or t
  misc_feature (34)..(34): n is a, c, g, or t
  misc_feature (43)..(43): n is a, c, g, or t
  misc_feature (47)..(47): n is a, c, g, or t
  misc_feature (56)..(56): n is a, c, g, or t
  misc_feature (70)..(70): n is a, c, g, or t
  misc_feature (93)..(93): n is a, c, g, or t
  misc_feature (99)..(99): n is a, c, g, or t
  misc_feature (128)..(128): n is a, c, g, or t
  misc_feature (163)..(163): n is a, c, g, or t
cccaaactacccacagacctgaccttaccgnctncgacactgnatgnagacagagnccctgctctgcttnccatgccttgaccaagtagcagncgcagncaacatgcattgatgtgtgctgctgcagnactcacagggtcatggagcagcatgagtacatggnaccgtgccagggcagtacagcacccgcttggctgtgctgagtcagcagcctgtacccattggaagaagctgtccaccgctgccgtctcttaccagccagccccaccaagtgctggccagtgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 306755 - DNA, 868 bp, Homo sapiens
ggacgcgtgggtcgacccacgcgtcggccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggtctccaggatagctgcttatgcctacagtgcactttctcagatccgtgtggacgcaaaagaggagctggttgtacagtttgggatcccatgaagagaggggtccttggacagctcttctcctctcttcatcccatctctaccccacccccttggcccccagcctcactgcggcttatacagtaccctaacctgctactaatcacagagaaaaatgtgaagaaggaggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcca

SEQ ID NO: 306756 - DNA, 2035 bp, Homo sapiens
agcggagtgactgaggcggccaagcggctccgggacagggggtacggggggtgggggcgggtggttgcctgcgggaggccgccgcgggtcatgtgaccggaagggctcctcacggacgccgtccctcctcggcgcggcctgagcgcccggcccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccatcccgttctctgatttgcagcaggttcagctgtttcagtccacaccttgttcacagtaagatattcaattcaattcagcaaacatttgttgtgtgcttgctgctctgtgcctgaccagaagaaatgaagccaagatacaaataatagaaccctgtcatgagcacagaaagacctgctgagtttctattgattgtggtaaaccagcctgcatccagttccaagtaacagctgcccacttagtgaatactctctcatgtttcaacactcagttctagtgtagcctcttctataaagcctttcttttccagataaaattggttaatgtgtcctgtgttaggctgattgttttgatgatccctattcatggtctcccctgtatccatctctttttgcctataacattgtagtcccatctcactctgatgctgggaccagacatgtgacttgttttagccaatgagatgtcgataaacatgaagcaaacagaagctttaaaggaggcctgccctcttgctctttgccagtgccatgagaacatggctgatcagctggagggttatgagatgtgtaggtgagagacatgcgaaagagccagagataccagctgaagccatcctagactagcccacagtcagcctacccccagtcaagatcaggagagtcacccaacccacagatgactgccgacacatgagtaagcccagccaaagcagaagaaccctccagctgactctaagacttagaagcaataataaatgtttattatcttaagccactgtgttttgggatggtttattacacggcaatagctaacttctgcatgcccccactgtacttcaaacaaaattttattacagcttgtttactcatctgtgaaatggagacaaaccctaccttgagaactattgtacatctggcatcaggtgctcaataaatggaagcagttgtattctctgttaatttcattataaccaactttgtttactccctataagcttgaggacagggacaagactcagacttctttctcccttctcatcattaccctgcattgagcctggccaaaaaaaaaaaaaaaatccatattcactaaaggtttgatggacaaatgaaaatggatggacaatggaaaaatgaaagaagaaatgaaggaattaatggagtcttcaaggtgtcacatagagagcttgactgctggggagaactgacaaagtgttgatgctgccatgcttactcctgtggctgtgtttttggagtcagtctttcccatctgctattctggcttatgaccaggaggtaatcagatgccagcaccttcatctgtccagactgactaacttgatgaatgacagggttaggggcatacctgccttgtttcggaactggaatttctcatttccaaattgacagtatctttaactgttttgttttttaactgtaaaagctaatatgatagatgaataaagtgaaatgacaagaagtacatcaaatagaaactcaaa

SEQ ID NO: 306757 - DNA, 725 bp, Homo sapiens
  misc_feature (717)..(717): n is a, c, g, or t
agcggagtgactgaggcggccaagcggctccgggacagggggtacggggggtgggggcgggtggttgcctgcgggaggccgccgcgggtcatgtgaccggaagggctcctcacggacgccgtccctcctcggcgcggcctgagcgcccggcccgaccccggccatggggtgctgctacagcagcgagaacgaggactcggaccaggaccgagaggagcggaagctgctgctggaccctagcagcccccctaccaaagctctcaatggagccgagcccaactaccacagcctgccttccgctcgcactgatgagcaggccctgctctcttccatccttgccaagacagccagcaacatcattgatgtgtctgctgcagactcacagggcatggagcagcatgagtacatggaccgtgccaggcagtacagcacccgcttggctgtgctgagcagcagcctgacccattggaagaagctgccaccgctgccgtctcttaccagccagccccaccaagtgctggccagtgagcccaactaccacagcctgccttccgctcgcactgatgagcaggccctgctcttcttccatccttgccaagacagccagcaacatcattgatgtgtctgctgcagacttcacagggcatgggagcagcatgagtacatgggaccgtgccagggagttacagcacccgtttgggtgtgctgaggagcagncttgaccc

SEQ ID NO: 306758 - DNA, 1295 bp, Homo sapiens
tcgagcctcggccctgatgtgctgcccacttagtgaatactctctcatgtttcaacactcagttctagtgtagcctcttctataaagcctttcttttccagataaaattggttaatgtgtcctgtgttaggctgattgttttgatgatccctattcatggtctcccctgtatccatctctttttgcctataacattgtagtcccatctcactctgatgctgggaccagacatgtgacttgttttagccaatgagatgtcgataaacatgaagcaaacagaagctttaaaggaggcctgccctcttgctctttgccagtgccatgagaacatggctgatcagctggagggttatgagatgtgtaggtgagagacatgcgaaagagccagagataccagctgaagccatcctagactagcccacagtcagcctacccccagtcaagatcaggagagtcacccaacccacagatgactgccgacacatgagtaagcccagccaaagcagaagaaccctccagctgactctaagacttagaagcaataataaatgtttattatcttaagccactgtgttttgggatggtttattacacggcaatagctaacttctgcatgcccccactgtacttcaaacaaaattttattacagcttgtttactcatctgtgaaatggagacaaaccctaccttgagaactattgtacatctggcatcaggtgctcaataaatggaagcagttgtattctctgttaatttcattataaccaactttgtttactccctataagcttgaggacagggacaagactcagacttctttctcccttctcatcattaccctgcattgagcctggccaaaaaaaaaaaaaaaatccatattcactaaaggtttgatggacaaatgaaaatggatggacaatggaaaaatgaaagaagaaatgaaggaattaatggagtcttcaaggtgtcacatagagagcttgactgctggggagaactgacaaagtgttgatgctgccatgcttactcctgtggctgtgtttttggagtcagtctttcccatctgctattctggcttatgaccaggaggtaatcagatgccagcaccttcatctgtccagactgactaacttgatgaatgacagggttaggggcatacctgccttgtttcggaactggaatttctcatttccaaattgacagtatctttaactgttttgttttttaactgtaaaagctaatatgatagatgaataaagtgaaatgacaagaagtacatcaaatagaaactcaaa

SEQ ID NO: 306759 - DNA, 940 bp, Homo sapiens
gatgctgcgagtaaacgccttgatataccatgatgagtccgtctcgtagacggactcgcaggctcaatctcgtatccccacagatcaagatcaggagagtcacccaacccacagatgactgccgacacatgagtaagcccagccaaagcagaagaaccctccagctgactctaagacttagaagcaataataaatgtttattatcttaagccactgtgttttgggatggtttattacacggcaatagctaacttctgcatgcccccactgtacttcaaacaaaattttattacagcttgtttactcatctgtgaaatggagacaaaccctaccttgagaactattgtacatctggcatcaggtgctcaataaatggaagcagttgtattctctgttaatttcattataaccaactttgtttactccctataagcttgaggacagggacaagactcagacttctttctcccttctcatcattaccctgcattgagcctggccaaaaaaaaaaaaaaaatccatattcactaaaggtttgatggacaaatgaaaatggatggacaatggaaaaatgaaagaagaaatgaaggaattaatggagtcttcaaggtgtcacatagagagcttgactgctggggagaactgacaaagtgttgatgctgccatgcttactcctgtggctgtgtttttggagtcagtctttcccatctgctattctggcttatgaccaggaggtaatcagatgccagcaccttcatctgtccagactgactaacttgatgaatgacagggttaggggcatacctgccttgtttcggaactggaatttctcatttccaaattgacagtatctttaactgttttgttttttaactgtaaaagctaatatgatagatgaataaagtgaaatgacaagaagtacatcaaatagaaactcaaa

SEQ ID NO: 306760 - DNA, 390 bp, Homo sapiens
gtgacactcttgagggcactgaggccaagggagatgggcctagattgagtctgtgatgagctgagaccttccctcccagatacccctcctcgacaccctgcttctctggcctgaggggatgaggcttacctgggctgggcagggcagactgtagcttaactgcctacccccaccccctctctcttggtcagcacccgcttggctgtgctgagcagcagcctgacccattggaagaagctgccaccgctgccgtctcttaccagccagccccaccaagtgctggccagtgagcccatcccgttctctgatttgcagcaggtgagacacccctcacctgcccctgcccacccttctcacactgcccagggtatggcagagggttcacccact

SEQ ID NO: 306761 - DNA, 5115 bp, Homo sapiens
  misc_feature (4961)..(4961): n is a, c, g, or t
  misc_feature (5002)..(5002): n is a, c, g, or t
  misc_feature (5031)..(5031): n is a, c, g, or t
gagacttgcaggcagcaaacacggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaaccctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcatgcacaaggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcagctccctcgcaagtgagcggagtaatgaaggagagagtactgcagcggagtgtcgagctttcctggcaggaaccagagcatcccaatggagtcatcacagaatatgaaatcaagtattacgagaaagatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacaggtaaaatgtttgaagctacagctgtctccagtgaacagaatcctgttattatcattgctgtggttgctgtagctgggaccatcattttggtgttcatggtctttggcttcatcattgggagaaggcactgtggttatagcaaagctgaccaagaaggcgatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccaaatgttgtccatttggaaggggttgttacaagagggaaaccagtcatgatagtaatagagttcatggaaaatggagccctagatgcatttctcaggaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggccaataagccctcttctggatcaaaacactcctgatttcactaccttttgttcagttggagaatggctacaagctattaagatggaaagatataaagataatttcacggcagctggctacaattcccttgaatcagtagccaggatgactattgaggatgtgatgagtttagggatcacactggttggtcatcaaaagaaaatcatgagcagcattcagactatgagagcacaaatgctacatttacatggaactggcattcaagtgtgatatgcatttctcccttttaagggagattacagactgcaagagaacagtactggccttcagtatatgcatagaatgctgctagaagacaagtgatgtcctgggtccttccaacagtgaagagaagatttaagaagcacctatagacttgaactcctaagtgccaccagaatatataaaaagggaatttaggatccaccatcggtggccaggaaaatagcagtgacaataaacaaagtactacctgaaaaacatccaaacaccttgagctctctaacctcctttttgtcttatagactttttaaaatgtacataaagaatttaagaaagaatatatttgtcaaataaaatcatgatcttattgttaaaattaatgaaatattttccttaaatatgtgatttcagactattcctttttaaaatcatttgtgtttattcttcataaggactttgttttagaaagctgtttatagctttggacctttttagtgttaaatctgtaacattactacactgggtacctttgaaagaatctcaaatttcaaaagaaatagcatgattgaagatacatctctgttagaacattggtatcctttttgtgccattttattctgtttaatcagtgctgttttgatattgtttgctaattggcaggtagtcaagaaaatgcaagttgccaagagctctgatattttttaaaaagaatttttttgtaaagatcagacaacacactatcttttcaatgaaaaaagcaataatgatccatacatactataaggcacttttaacagattgtttatagagtgattttactagaaagaatttaataaactcgaagtttaggtttatgagtatataaacaaatgaggcacttcatctgaagaatgttggtgaaggcaagtctctgaaagcagaactatccagtgttatctaaaaattaatctgagcacatcaagattttttcattctcgtgacattaggaaatttaggataaatagttgacatatattttatatcctcttctgttgaatgcagtccaaacatgaaaggaaataattgttttatattataactctgaagcatgataaaggggcagttcacaattttcaccatttaaacacaaatttgctgcacagaatatcaccattgcagttcaaaacaaaacaaaacaaaaagtcttttgtttgtgaacactgatgcaagaaacttgttaaatgaaaggactctttaccctagaaggaagaggtgaaggatctggcttgtttttaaagctttatttattaaaccatattatttgattactgtgttagaatttcataagcaataattaaatgtgtctttatagatattgcaggaatgtatacatattgtgattaatgctttcaaaacttatgaaaatcatgaactaccccagaattgaactgttgtacttccaaagagaattgggctgtttataatgattttaatagagaaagatcccagggatcggtcataattggtcttgtttgataatgtgggcatccacaaacaaacaaacaaataacagaaacaaaatctgtaaatgttcctttgtaaaacttgtaaattttatttatactgtcttgttttgtacacacatttctctgtagtgggctctgaatacattgaaaatgcactatatttttctattttacttgcagagcatcacaaaagaacaggtattttcagtgctacataatgtgttttcccacatttaggaccaaagacggctatagaaaaacnaagtgagaacatgagggttggttttctgttcctgctttagntcacttaggataatcgcctccagctccantcatgttgcttcaatgaacgtgatcttgtgctttttaatggctgcatagtatgccacagtgtatatctgccacactttctttaa

SEQ ID NO: 306762 - DNA, 6617 bp, Homo sapiens
gagacttgcaggcagcaaacacggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaaccctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcatgcacaaggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcagctccctcgcaagtgagcggagtaatgaaggagagagtactgcagcggagtgtcgagctttcctggcaggaaccagagcatcccaatggagtcatcacagaatatgaaatcaagtattacgagaaagatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacaggtaaaatgtttgaagctacagctgtctccagtgaacagaatcctgttattatcattgctgtggttgctgtagctgggaccatcattttggtgttcatggtctttggcttcatcattgggagaaggcactgtggttatagcaaagctgaccaagaaggcgatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccaaatgttgtccatttggaaggggttgttacaagagggaaaccagtcatgatagtaatagagttcatggaaaatggagccctagatgcatttctcaggaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggccaataagccctcttctggatcaaaacactcctgatttcactaccttttgttcagttggagaatggctacaagctattaagatggaaagatataaagataatttcacggcagctggctacaattcccttgaatcagtagccaggatgactattgaggatgtgatgagtttagggatcacactggttggtcatcaaaagaaaatcatgagcagcattcagactatgagagcacaaatgctacatttacatggaactggcattcaagtgtgatatgcatttctcccttttaagggagattacagactgcaagagaacagtactggccttcagtatatgcatagaatgctgctagaagacaagtgatgtcctgggtccttccaacagtgaagagaagatttaagaagcacctatagacttgaactcctaagtgccaccagaatatataaaaagggaatttaggatccaccatcggtggccaggaaaatagcagtgacaataaacaaagtactacctgaaaaacatccaaacaccttgagctctctaacctcctttttgtcttatagactttttaaaatgtacataaagaatttaagaaagaatatatttgtcaaataaaatcatgatcttattgttaaaattaatgaaatattttccttaaatatgtgatttcagactattcctttttaaaatcatttgtgtttattcttcataaggactttgttttagaaagctgtttatagctttggacctttttagtgttaaatctgtaacattactacactgggtacctttgaaagaatctcaaatttcaaaagaaatagcatgattgaagatacatctctgttagaacattggtatcctttttgtgccattttattctgtttaatcagtgctgttttgatattgtttgctaattggcaggtagtcaagaaaatgcaagttgccaagagctctgatattttttaaaaagaatttttttgtaaagatcagacaacacactatcttttcaatgaaaaaagcaataatgatccatacatactataaggcacttttaacagattgtttatagagtgattttactagaaagaatttaataaactcgaagtttaggtttatgagtatataaacaaatgaggcacttcatctgaagaatgttggtgaaggcaagtctctgaaagcagaactatccagtgttatctaaaaattaatctgagcacatcaagattttttcattctcgtgacattaggaaatttaggataaatagttgacatatattttatatcctcttctgttgaatgcagtccaaacatgaaaggaaataattgttttatattataactctgaagcatgataaaggggcagttcacaattttcaccatttaaacacaaatttgctgcacagaatatcaccattgcagttcaaaacaaaacaaaacaaaaagtcttttgtttgtgaacactgatgcaagaaacttgttaaatgaaaggactctttaccctagaaggaagaggtgaaggatctggcttgtttttaaagctttatttattaaaccatattatttgattactgtgttagaatttcataagcaataattaaatgtgtctttatagatattgcaggaatgtatacatattgtgattaatgctttcaaaacttatgaaaatcatgaactaccccagaattgaactgttgtacttccaaagagaattgggctgtttataatgattttaatagagaaagatcccagggatcggtcataattggtcttgtttgataatgtgggcatccacaaacaaacaaacaaataacagaaacaaaatctgtaaatgttcctttgtaaaacttgtaaattttatttatactgtcttgttttgtacacacatttctctgtagtgggctctgaatacattgaaaatgcactatatttttctattttacttgcagagcatcacaaaagaacaggtattttcagtgctacataatgtgttttcccacatttaggaccaaagacggctatagaaaaactcaaatggattgcttcccaaacccctccccaccctttttttttggttttaaatcactgtacagtgttatttgatattttaatttattttttgattgactagaaaaatcattttaatttcactaaaatgttttttgtccctaaggaaaagtaatctgtaaaaataattttaattagcataatacagtcacctagacacttccatttgtaatctttgtaatagactgtaaatatatttttggaactataacacaatgtgcttgagggttatttttcagtgtctgcagtgtgtacaagtgtttatactaagtccagcactttacaattctaatcagtagcattggcctttgtgagaatgagtgaaagagtttgagtgagtgttcttaattccttttggattctagactcactaataatgaagttcttttcttgttcatagcttaaggtgcttattttttctattaaaattaaattaacaaaagccattctagaaatagaagacatagtatggtacatgcaaacggtgtctttcctgcttttttctagcactagatttatagttgagtagtctttcttgagtagaagggcagaataaaagtttttttgagtttttttcaaaaataactttttccttcagcaatatacctcatctgccttaaattttttacagctctttacagggaaaggggagaagggatgggaaagacacacagcacaataggaagtgtatgattacatcactatctcgtttgtaagtttcttttcctaatcaacattatgatttcgaaatacatgtatgtgaaacaaatattaagagaaaaagaattaacattgtaatgctgattgtaatactctcttccagaaagagatgagatggtataacgataagaatgtacaacttgcaccttgaaatctttttttttaaataaattagtgctcaggggaggaaaagtagagaaagtgaacgtcaaaaatagaattccaaaattataaaaatgcaaaaggaaatggcctccttgctttaatagagccaccttttttagaacactgtcctcacacttgacctgtgttttgcattcagtactgaaataaaagtaacttgttctacatttgaatctaacattttctcagcaattgatctggtccttgtttactagaactggtggtttatgcttgtcagagcactattagttgaatcatattgtatacttatgtaatctacattagctagtactgtttaggactatattttaattgctcttcttatccgtgtttttaagacaattaaaatggtgtgattcacctctcttttttatttaggtaatgctgatattctcccttttgtttcttgagtagcctagaactatgctactcactgatgtgcatgttcaaataaattactgatgtgtatttttttgctatatgtggagaaatcatggggaactcggggcgagatgtgcttttcgttggttgaatttgtccctccttgcctaagaaatactacaggggtcatccttttataaggacaaactgcttttgaacagtgtcttcaatgtatcaagcacaaataactctttcttcaacatgaatcataagtctctttttaccagcttaaaataataaacaagtctattagacaatgtaaagaaaaaaatgtct

SEQ ID NO: 306763 - DNA, 470 bp, Homo sapiens
tatcggtttccagaggatccccgtcgtccaggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306764 - DNA, 737 bp, Homo sapiens
  misc_feature (143)..(143): n is a, c, g, or t
  misc_feature (715)..(715): n is a, c, g, or t
tcaacttttgataggagatatcgtcttgattgccctgagcctgactgcgtgtctggaggagatcattattttgccatgggcatgttcatataggcgcagaggcaatgcttcgaatcccggtgttcctctgttatgcacatggnggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgattgaaaaaaaaaaaaaaaaaaaaaaaaaaaaaaaaaaaaaaaaaaaaaaaaaaaaaaaaaaaaaaacccttgtggcccgcttggcccaagtcaattttaaactggaccaggttaatccttgcggccgaatttggggctaattggcccatttccccctatggggggcggtttaacattccatggcccgnggtttaacacggcggggacggg

SEQ ID NO: 306765 - DNA, 497 bp, Homo sapiens
ggaagaattcctggtggtgatggaagaattcccggtggtgatggaagaattcctggtggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcaaaatttttttttgggggggttttttttttttttttttaaaaaaaaaaggggggggtctcttgtgtacttattgtttaaggtttcctcaaactgtgatttttctgaacacaataaactattttgatgat

SEQ ID NO: 306766 - DNA, 420 bp, Homo sapiens
cttaatcatgtgcctaagtgctccctgtatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306767 - DNA, 391 bp, Homo sapiens
tttaggtctttaatccacttgaagttgatttttatgtagagtgagagatggaggtctagtttcattcttctgcatgtggctatttagttttcccagcaccatttattgaaaagattgttctttcccccaattaacgttcttggcatctttgtcaaaaatgggttgcctgtagataaatggattaatttggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306768 - DNA, 261 bp, Homo sapiens
cgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctcttggagctcactggtccctgcctctggggctttactgaagaaacccaccg

SEQ ID NO: 306769 - DNA, 128 bp, Homo sapiens
gcggccgcctactactactactgctcgaattcaagcttctaacgatgtacggggatctcttgtgtacttattgtttaaggtttcctcaaactgtgatttttctgaacacaataaactattttgatgat

SEQ ID NO: 306770 - DNA, 129 bp, Homo sapiens
tcggatccaacgttggatccgaatcggatccaattggatccgattcggatccaagctctcttgtgtacttattgtttaaggtttcctcaaactgtgatttttctgaacacaataaactattttgatgat

SEQ ID NO: 306771 - DNA, 287 bp, Homo sapiens
ttcaaaatagtttattgtgttcagaaaaatcacagtttgaggaaaccttaaacaataagtcacaagagatgccccatggggcattccatagcagagacagactcctgtatgttttattccagaggcattgcatggtgataataaaatgataggaaatagaggaaaatagatacaggaaaaggcaatagacagggaagccagctagatgttagagtctcttgtgtacttattgtttaaggtttcctcaaactgtgatttttctgaacacaataaactattttgatgat

SEQ ID NO: 306772 - DNA, 468 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgagaggtaactgggctcaccaacaggccctgtggaactcgtccacggcacctggctttc

SEQ ID NO: 306773 - DNA, 1395 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccgg

SEQ ID NO: 306774 - DNA, 1242 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306775 - DNA, 1293 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatgatgctggacgacggggatcctctggaacgctatgaccctgatacgacctg

SEQ ID NO: 306776 - DNA, 2119 bp, Homo sapiens
  misc_feature (1568)..(1568): n is a, c, g, or t
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgattgaaaaaaaaaaaaaaaaaaaaaaaaaaaaaaaaaaaaaaaagggggggggcccccaaaaattcccccggagggggcgcccaaaggaatatacgcggatatacccgaggttatcttgtggaaccaagaggggcgcccccataataggagagagagcgcggaattataaagcgacgcaaagagcgagcccaggggccagcgaggttataaacaacgtaggagcacgcgggcgacaacacgtgaacacaagggaggaacccctgcgggaaagaggaacaccataaaacacgggcggagggcggggacacaacagtggcgggaccaccnacacctcccccacaaagagagactattaaaacgccctcatgagggagaaacaatcaataaaacattcaacaacgggctatacaaacggggggggttacacaacaccaccaagggcggacaaattaatgacagagcgacagcgtactgggacaaaacaagtattgggcgcaccaaccgagggagatttctaagcgtacatatagcagacaaacaatttttttttttaccaccacggggaggcgaaggatcgagtacatcgaacaacacatcagacgaaaagcgcaacacgcgacgaccacgcagcacaaccggccgaaaagaccggccgacacggccagccagcaccgacacgacgcgacgcccgcacaaccaagaccggaccaaggcggcaagcgtcaatccgaacgagagcacacagaagagaaagacgagaacggcacgcgcggccagcgacgcaagagcacgctgacacaaaagcgcactccgcgcgcacacacgcgaaccaaccacacctacaccacccacaacgccacccaaccgacgcacccacc

SEQ ID NO: 306777 - DNA, 1451 bp, Homo sapiens
  misc_feature (1429)..(1429): n is a, c, g, or t
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgattgaaaaaaaaaaaaaaaaaaaaaaaaaaaaaaaaaaaaaaaaaaaaaaaaaaaaaaaaaaaaaaacccttgtggcccgcttggcccaagtcaattttaaactggaccaggttaatccttgcggccgaatttggggctaattggcccatttccccctatggggggcggtttaacattccatggcccgnggtttaacacggcggggacggg

SEQ ID NO: 306778 - DNA, 1360 bp, Homo sapiens
  misc_feature (1248)..(1248): n is a, c, g, or t
  misc_feature (1262)..(1262): n is a, c, g, or t
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgataaaaantaattaataatatntaaatgtaatgaaaatctcctacaaatacttactttattatataaatgtttcccacccttttccacacttcattgcagtgttcgatatttctatcaag

SEQ ID NO: 306779 - DNA, 1269 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatatgtagcgtactcggggatcgtctata

SEQ ID NO: 306780 - DNA, 1172 bp, Homo sapiens
tgctcggtacctgcatttactccatggctccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306781 - DNA, 1342 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaatctcttgtgtacttattgtttaaggtttcctcaaactgtgatttttctgaacacaataaactattttgatgatacaattaccccctcttccttttttttatatattttttttttattaaatccggtcggcccggcttgggcccaagccacttttagactcgggcaagcttatgcttgcggccgcattcggggctaacttggccaattggccttatagtgg

SEQ ID NO: 306782 - DNA, 916 bp, Homo sapiens
tggattacacactttaatctgattgacactgaggaagtagggaggacatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306783 - DNA, 823 bp, Homo sapiens
  misc_feature (7)..(7): n is a, c, g, or t
tagatcnagctcggtaccggccccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306784 - DNA, 1171 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttccccttcctgccctcaactgaggacgtttacgactgcagggtggagcactggggcttggatgagcctcttctcaagcactgggggt

SEQ ID NO: 306785 - DNA, 1061 bp, Homo sapiens
  misc_feature (1045)..(1045): n is a, c, g, or t
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctcaaatnatgggtgccaggctca

SEQ ID NO: 306786 - DNA, 1531 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggagtggggttcttagagagaagatcactgaagaaacttctgctttaatgactttacaaagctggcaatattacaatccttgacctcagtgaaagcagtcatcttcagcgttttccagccctatagccaccccaagtgtggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccgg

SEQ ID NO: 306787 - DNA, 1193 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306788 - DNA, 1226 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306789 - DNA, 1092 bp, Homo sapiens
tgctcggtacctgcatttactccatggctccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306790 - DNA, 1531 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactggggtatggaccaacactcaatctcctttatttcaaggtttcctcctatgatgcttgtgtgaaactcggtgttctaactgtttcataatatctgctacaattaatataactgtcttctcctactatccagcttcctcctttttttaatctgtaattctctcaatacatcattctgtcttcctcttctttaatctatgaataacttttctctttattaagaaccctacatttgattctgagtgttacttcttcccacactcattaccatgtactctgccttatttccccccagagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306791 - DNA, 919 bp, Homo sapiens
  misc_feature (883)..(883): n is a, c, g, or t
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggagtgatgtttcttagagagaagaattntccccaaaaccctttgggggaaaaaaaggggaaaaa

SEQ ID NO: 306792 - DNA, 1340 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccgg

SEQ ID NO: 306793 - DNA, 848 bp, Homo sapiens
  misc_feature (821)..(821): n is a, c, g, or t
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaaggcaattccacaggggccantccacaggggccggtaccgagctgatt

SEQ ID NO: 306794 - DNA, 1486 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactggggtatggaccaacactcaatctcctttatttcaaggtttcctcctatgatgcttgtgtgaaactcggtgttctaactgtttcataatatctgctacaattaatataactgtcttctcctactatccagcttcctcctttttttaatctgtaattctctcaatacatcattctgtcttcctcttctttaatctatgaataacttttctctttattaagaaccctacatttgattctgagtgttacttcttcccacactcattaccatgtactctgccttatttccccccagagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagcttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306795 - DNA, 619 bp, Homo sapiens
ttcaaaatagtttattgtgttcagaaaaatcacagtttgaggaaaccttaaacaataagtcacaagagatgccccatggggcattccatagcagagacagactcctgtatgttttattccagaggcattgcatggtgataataaaatgataggaaatagaggaaaatagatacaggaaaagagtgcgcaaaagcaatgcagcagaacgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306796 - DNA, 673 bp, Homo sapiens
gacattctcttttcttttattcttgtctgttctgcctcactcccgagctctactgactcccaacagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcttggataaaaggaggccgagctcgatt

SEQ ID NO: 306797 - DNA, 553 bp, Homo sapiens
tggattacacactttaatctgattgacactgaggaagtagggaggacatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgagttaggtgtggtcagag

SEQ ID NO: 306798 - DNA, 595 bp, Homo sapiens
ggaagaattcctggtggtgatggaagaattcccggtggtgatggaagaattcctggtggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccgg

SEQ ID NO: 306799 - DNA, 566 bp, Homo sapiens
cgcagggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccgg

SEQ ID NO: 306800 - DNA, 681 bp, Homo sapiens
  misc_feature (143)..(143): n is a, c, g, or t
tcaacttttgataggagatatcgtcttgattgccctgagcctgactgcgtgtctggaggagatcattattttgccatgggcatgttcatataggcgcagaggcaatgcttcgaatcccggtgttcctctgttatgcacatggnggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccgg

SEQ ID NO: 306801 - DNA, 581 bp, Homo sapiens
  misc_feature (37)..(37): n is a, c, g, or t
ccgttgtgaggctcttcgggtggcccgttgtgtggcncatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgatcttgggtggaatttttggtgtttaagccagttctttgggtggcggtggggggtggggagtcggtcctggggaatatatgtgatcctttcccggtaaaatatctgaatgttgaatttatcttataaattctagaattcatcagacatatcccgg

SEQ ID NO: 306802 - DNA, 1321 bp, Homo sapiens
  misc_feature (5)..(5): n is a, c, g, or t
  misc_feature (16)..(16): n is a, c, g, or t
  misc_feature (24)..(24): n is a, c, g, or t
  misc_feature (770)..(770): n is a, c, g, or t
cgcgnccgcgcgacgntgcgagangacgacagaaggggggcctctgtaaggcacatggaggtgatggtgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgattgaaaaaaaaaaaaaaaaaaaaaaaaaaaaaaaaaaaaaaaagggggggggcccccaaaaattcccccggagggggcgcccaaaggaatatacgcggatatacccgaggttatcttgtggaaccaagaggggcgcccccataataggagagagagcgcggaattataaagcgacgcaaagagcgagcccaggggccagcgaggttataaacaacgtaggagcacgcgggcgacaacacgtgaacacaagggaggaacccctgcgggaaagaggaacaccataaaacacgggcggagggcggggacacaacagtggcgggaccaccnacacctcccccacaaagagagactattaaaacgccctcatgagggagaaacaatcaataaaacattcaacaacgggctatacaaacggggggggttacacaacaccaccaagggcggacaaattaatgacagagcgacagcgtactgggacaaaacaagtattgggcgcaccaaccgagggagatttctaagcgtacatatagcagacaaacaatttttttttttaccaccacggggaggcgaaggatcgagtacatcgaacaacacatcagacgaaaagcgcaacacgcgacgaccacgcagcacaaccggccgaaaagaccggccgacacggccagccagcaccgacacgacgcgacgcccgcacaaccaagaccggaccaaggcggcaagcgtcaatccgaacgagagcacacagaagagaaagacgagaacggcacgcgcggccagcgacgcaagagcacgctgacacaaaagcgcactccgcgcgcacacacgcgaaccaaccacacctacaccacccacaacgccacccaaccgacgcacccacc

SEQ ID NO: 306803 - DNA, 665 bp, Homo sapiens
tgctcggtacctgcatttactccatggctccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaggcttccctgtctattgccttttcctgtatctattttcctctatttcctatcattttattatcaccatgcaatgcctctggaataaaacatacaggagtctgtctctgctatggaatgccccatggggcatctcttgtgtacttattgtttaaggtttcctcaaactgtgatttttctgaacacaataaactattttgatgat

SEQ ID NO: 306804 - DNA, 591 bp, Homo sapiens
cttgtcttgtcactcatccctactcgccatcattctttcattcctcttggccaatctctctccactacttcctgcctacatgtatgtaggttattcatttccctctcttgattccccccacccaactctctttctccatttctcgcctttcagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatggtacctccctctctgctgcactcctggacatgggaatccatagtttgaaagtagttgcttcagctctttgtgttagattattgtaactgattttccctccaagggcctaaccttgccattaacaagccccaaattctcatgccagaggtctgagaactttatgggtttgatcctatcttgttgtgctcaagt

SEQ ID NO: 306805 - DNA, 6722 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306806 - DNA, 3474 bp, Homo sapiens
aactaaattttacctaacatgattatacattcactcagacccagtaaaattacttaaacatttcattgaataaactttattttctttttgttttatttcagaatattgtactaggttgagtccctcttcagtaaacccgagttacttagtattgtatgtctgtgatttgcactatagatggcagtatatcatttctattagaatgtgtaacttctatagcattgttaaaagtttatttgactaagatcaaaatatttattttgtggattaaaaaatattttccttttgtaaacttaattggaatttgcaatttatgtatcttgtgaagaaatttgacacctggatttggggaggaaaaaacaagataggaaactaaaagaaaaagaaacattattttacactggtaaggcaatgtgagtaaaatgaactcattgtccatctacatggctcagctttttttctatttaccatctgttttccatttggagaaaatcttatccatggaagaattaaatttaacatagttatatattttggattttgaaaataaaacctgtgtagatgaatctcgattttataaaggaaatacatttgaagtgcttataaaaagaaagagtaattggtttattgaagatgttgtgcctctgttactacttgagaatggaataacttctgtctaatcataaaaattgtaatgccaatattggtactttttcaaattactgtgttctcataaaggtttgctttcgtcccattagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306807 - DNA, 1133 bp, Homo sapiens
aactaaattttacctaacatgattatacattcactcagacccagtaaaattacttaaacatttcattgaataaactttattttctttttgttttatttcagaatattgtactaggttgagtccctcttcagtaaacccgagttacttagtattgtatgtctgtgatttgcactatagatggcagtatatcatttctattagaatgtgtaacttctatagcattgttaaaagtttatttgactaagatcaaaatatttattttgtggattaaaaaatattttccttttgtaaacttaattggaatttgcaatttatgtatcttgtgaagaaatttgacacctggatttggggaggaaaaaacaagataggaaactaaaagaaaaagaaacattattttacactggtaaggcaatgtgagtaaaatgaactcattgtccatctacatggctcagctttttttctatttaccatctgttttccatttggagaaaatcttatccatggaagaattaaatttaacatagttatatattttggattttgaaaataaaacctgtgtagatgaatctcgattttataaaggaaatacatttgaagtgcttataaaaagaaagagtaattggtttattgaagatgttgtgcctctgttactacttgagaatggaataacttctgtctaatcataaaaattgtaatgccaatattggtactttttcaaattactgtgttctcataaaggtttgctttcgtcccattagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaaagattttattcaacagtacttcagaaatccatgctgctattgcttatttctgattcctgtaattaaaatttaaaatgtaatgaaacagtatttgaacatggtttgtgaattgtaatattccacacaaatataattctatattgcttatatattgaaataatatattttatcagcatttgatgagtaccaagaagccattaaatt

SEQ ID NO: 306808 - DNA, 7094 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306809 - DNA, 6800 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttgtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306810 - DNA, 7209 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306811 - DNA, 7156 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306812 - DNA, 7151 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaagaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306813 - DNA, 5568 bp, Homo sapiens
atacaaaacttgagaaagcaaagtctccaacagcagatgccaaagtggtttctttgtctttacagactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306814 - DNA, 7239 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306815 - DNA, 7036 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306816 - DNA, 6761 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccggccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306817 - DNA, 6878 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccggattcaaccccgatggggaagaggaagatgttacagtacaagaatgactttctcttgattgttgaaaaatcattacctgtggaatggctaggaatattggaagcagcatagtgttgatccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306818 - DNA, 3167 bp, Homo sapiens
agtgtgggaggccagctgttacaacggacatgaagatgtgtgattattttcagtaggcagacatctaataaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagatgttacagtacaagaatgactttctcttgattgttgaaaaatcattacctgtggaatggctaggaatattggaagcagcatagtgttgatgtacgcaaaacaagacagcttggtcagctacaatcttggaatccctgtcttcttaattttatttatttatttttgacgtataatgtagtatatcaatcctttcaaactatttagataaccacttgatgcacaaataggaaaaagcagattgtggcagtgtcgccttttgtggttttatgattttcaaattgaatttaatgattacaccctttcccttcatagatcttttttcttttttttaagccatgctgtgacctacaagcaaactaaatagccaacatttctgaacccctaagtctcctgtgccaagctgctccctgaaatggacttcttcatctgtacagatttgttaaaccattctatttgcttcttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttgaaggaataaacgaaatgttaaaacagggtcaatccatttgaagaaaaagttggacaaaataatcagcattgctccctcttttatttaatatttgggtactgattatatccacatggaagtagaaggtaaggagtttaggaaaatactagaatctactctgcttacattcttgtttaagtgtttacacagtttggttcaattataaacatttggccttttactatgttatttttattttgtatgaatacattatcctccttatttatttttgttacatttattacttatgttattttgttatgcatttacaactccatttttaaataaagtgtttctggaacttt

SEQ ID NO: 306819 - DNA, 5692 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcagaatattatttaaagacaaagatcggaattgggatgacatagaaagcaaattaagagccgaaagtgaagtccctattgtgaaaacctcaagcatggagatttcttctatcttacaggaactgaaaagagtagaaaagcagctgcaagcaatcaatgctatgattgatcctgatggaactttggaggctctgaacaacatgggatttcccagtgctatgttgccatctccaccgaaacagaagtccagccctgtgaataaccaccacagcccgggtcagacaccaacacttggccaaccagaagctagggctcttcatcctgctgctgtttcagccgcagctgaatttgagaatgctgaatctgaggctgatttcagtatacatttcaatagattcaaccccgatggggaagaggaagaaaaaaaaaaaaaaaaaaaaaacaaaaagaaaaaaaaacaaaaaaaaaaaaaaaaaaacacagaaagaaagaaaaacagaacgaagaccacaacaacaagaacaaatgacagaaaataataagtagacatgacacaacaacaaggcgggggggcggggcacacataacatcccccgaccacgggaggaggccagacaaacgcaccaccccacttttagacacgcacagggcaggccgaaccaggtaggaggaggcctcacttaatcaatacggagagcagcggagggcgggtagctaaagagagagccttaggttgtcgggaagcaaaaaaggagggggagaatctatttcgagaagagacacaagaccacccagccggatcacgcccaacgaccacaacgcacaacgcccaaccaccaccaaccagacacacacgacaccccaaggccaacaaccccatacatcagacgcacagcagcaaacaaccaccaca

SEQ ID NO: 306820 - DNA, 5174 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcaaaacctcccacaggaaggcgtaacatctctcggattgatttattggctcagcctcgtagaacacgacttggctcactgtcagctcgtagtgactctgaagcaacaatttctagaagtagtgcctcttcgaggaccgcagaagccatcattagaagtggagccagactagtaccatcagataaattttctcctagaattagagctaacagtatctctcgactctcagactccaaggtcaaaagtatgacctcagctcatggctctgcttcagtaaattcaagatggaggcgctttcctactgattatgcttccacctcagaagatgaatttggatcaaaccgtaattcccctaaacatacccgtctacgtacttctccagccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagatagattcagtgacttcatcaggcactgcccctagtaccacagtaagcactgctgccaccacccctggctctgccatagacactagagaagaggtaggagatcttcatggagaaatgcataagttggttgatcgtgtttttgatgaaagcctcaacttccgaaagattcctccattagttcattccaaaacaccagaaggaaacaacggtcgatctggtgatccaagacctcaagcagcagagcctcccgatcacttaacaattacaaggcggagaacctggagcagggatgaagtcatgggagataatctgctgctgtcatccgtctttcagttctctaagaagataagacaatctatagataagacagctggaaagatcaggtacatgtacatatagctttaactttaatatcacctcactttgctttttgctttttctcaaggttaaaaatgtatcatcagaatgaatatgtttacctttggaaaaatttgtcccaaagtaaatatctatccagtactactttataactttaaatttattactaattcaaaacataaatagacttacagattttattcaacagtacttcagaaatccatgctgctattgcttatttctgattcctgtaattaaaatttaaaatgtaatgaaacagtatttgaacatggtttgtgaattgtaatattccacacaaatataattctatattgcttatatattgaaataatatattttatcagcatttgatgagtaccaagaagccattaaatt

SEQ ID NO: 306821 - DNA, 3951 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatgagacagagatcagtgagtctggcatgacagtgagaagtactggctctgcaacttccttggctagccagggagagagaaggagacgaactcttccccagcttccaaatgaagaaaagtctcttgagagccacagagcaaaggttgtaacacagaggtcagagataggagaaaaacaagacacagaacttcaggagaaagaaacacctacacaggtataccagaaagataaacaagatgctgacagacccttgagtaaaatgaacagggcagtaaatggagagactctcaaaactggtggagataataaaaccctacttcacttaggcagctctgctcctggaaaagagaaaagtgaaactgataaggaaacttctttggtaaagcaaacattagcaaaacttcaacaacaagaacaaagggaggaggctcagtggacacctactaaattgtcttccaaaaatgtttcaggtcagacagataaatgtagggaggaaacttttaaacaagaatcacaacctccagaaaaaaattcaggacattctacaagcaaaggagacagagtggcacaaagtgagagcaagagaagaaaagctgaggaaattctgaaaagtcagactccaaagggaggagacaagaaggaatcctccaagtcattagtgcgacaagggagcttcactatagaaaaacccagcccaaacatacccatagaacttattccccatataaataaacagacttcctctactccttcttctttagcattaacatctgcaagtagaatacgagaaagaagtgagtctttggatcctgattctagtatggacacaacccttattctaaaagacacagaagcagtaatggcttttctagaagctaaactacgtgaagataataaaactgatgaaggaccagatactcccagttataatagagacaattctatttcaccagaatctgatgtagatacagctagtacaatcagtctggttactggagaaactgaaagaaagtcaacccaaaagcgaaagagtttcactagcctctataaagataggtgttccacaggttctccttccaaagatgttacaaaatcatcatcttcaggtgctagggaaaaaatggaaaagaaaacaaaaagtcgttccacagatgtgggttcaagagcagatggtcgtaaatttgttcagtccagtgggagaataagacagccctcagtagacttaacagatgatgaccaaacctctagtgtacctcattctgccatctctgatattatgtcatctgatcaagaaacttactcttgtaaacctcatggacggactccacttacctcagctgatgagcatgtacattccaaactggaaggaagtaaagtaacgaaatctaagacttctccggtggtatctggttcatctagtaaatcaaccacccttccaaggccacgacctaccaggacttccctcttgcgcagagcacgacttggtgaagcttcagacagtgaacttgctgatgctgacaaagcatctgttgcttctgaagtatccacaacaagttctacatcgggaggaaaaaaccatgaagctggacatcagggtgcagcatagatgccagcaagttggggacaatctgcagctgcaattgaggagtcttttccttcttgagggccagtattta

SEQ ID NO: 306822 - DNA, 2460 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgacagcctcttctttttataagctcctttatcagacgtaacctcctcaaaagcaaagactgtcatacagattttgtaatcccctgcagtggctagccaagtagcctgtggagagtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatggtattctctttctctctttcattctttatcccttttttcttctctttctccatttctctctctttctcttactcttctctgcttttttgtgaatcatatatcagttgttattataaaaaacaagccaaatctatatagtaagaagtaagttaaacctaaataaacatattcacatattctcat

SEQ ID NO: 306823 - DNA, 2345 bp, Homo sapiens
aactgggcaggaggggatagggtccggcgcctcgccctttcccgaggcgcctgcgcactaggcagtcggtctttgccgttaccgctatgtgtggggcgtgtgtggaataacgttattgcccagcggagctgagggccccggagctcgaccgcagcggcagcgacgacaacagcggcgacgacgacgacgacgaggtggggggaggacggcgtgcgagagactcacgggacgcgacgcgccccgcctcccccgtccggtccctctctccacggtaaggggatgacgtagctttgccaaagacttagaagctaagcagaaaatgagcttaacatcctggtttttggtgagcagtggaggcactcgccacaggctgccacgagaaatgatttttgttggaagagatgactgtgagctcatgttgcagtctcgtagtgtggataagcaacacgctgtcatcaactatgatgcgtctacggatgagcatttagtgaaggatttgggcagcctcaatgggacttttgtgaatgatgtaaggattccggaacagacttatatcaccttgaaacttgaagataagctgagatttggatatgatacaaatcttttcactgtagtacaaggagaaatgagggtccctgaagaagctcttaagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatggatatttctgctatgccccgtggtactccattatatgggcagccgtcatggtggggggatgatgaggtggatgaaaaaagagctttcaagacaaatggcaaacctgaagaaaaaaaccatgaagctggaacatcagggtgcagcatagatgccaagcaagttgaggaacaatctgcagctgcaaatgaagaagtactttttcctttctgtagggaaccaagttattttgaaatccctacaaaagaattccagcaaccatcacaaataacagaaagcactattcatgaaatcccaacaaaagacacgccaagttcccatataacaggtgcagggcatgcttcatttaccattgaatttgatgacagtaccccagggaaggtaactattagagaccatgtgacaaagtttacttctgatcagcgccacaagtccaagaagtcttctcctggaactcaagacttgctggggattcaaacaggaatgatggcacccgaaaacaaagttgctgactggctagcacaaaacaaccctcctcaaatgctatgggaaagaacagaagaggattctaaaagcattaaaagtgatgttccagtgtacttgaaaaggttgaaaggaaataaacatgatgatggtacgcaaagtgattcagagaacgctggggctcacaggcgctgtagcaaacgtgcaactcttgaggaacacttaagacgccaccattcagaacacaaaaagctacagaaggtccaggctactgaaaagcatcaagaccaagctgttactagctctgcgcatcacagaggggggcatggtgttccacatgggaaattgttaaaacagaaatcagaggagccatcggtgtcaatacccttcctacaaactgcattattaagaagttcagggagtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattgacaaggtgtttggagtagatgacaatcaggattataataggcctgttatcaacgaaaaacataaagatctaataaaagattgggctctcagttctgctgcagcagtaatggaagaaagaaaaccactgactacatctggatttcaccactcagaggaaggcacatcttcatctggaagcaaacgttgggtttcacagtgggctagtttggctgccaatcatacaaggcatgatcaagaagaaaggataatggaattttctgcacctcttcctttagagaatggtattctctttctctctttcattctttatcccttttttcttctctttctccatttctctctctttctcttactcttctctgcttttttgtgaatcatatatcagttgttattataaaaaacaagccaaatctatatagtaagaagtaagttaaacctaaataaacatattcacatattctcat

SEQ ID NO: 306824 - DNA, 521 bp, Homo sapiens
gaagatggattcatggggaatcactcagcgtatattggccaaactgggctgtagaaatttaactggttatgagcattatctcacaaagtgctgttatatcatttaactctagtaattaggtgtaattgaatataataactacaaaaactacttactttccaccagaatttaactgatgctgttatatttgtttgcttatgtgctttgtattcagagctgaggccattgagatacatgtgtgaccaaagagtaatgaggtggatatttgtttgtgtcctatatgcatgttctcattacttcataatgagcctcatatgtggacgtggctgcaaaggccagtgtgggaggccagctgttacaacggacatgaagatgtgtgattattttcagtaggcagacatctaagtaagccctaagtcttgagttaagagtggaggggaagttgatatgaaatttcatctttttatttttgattggtttacatctaccacaccatctcctacaagaccctaaaggaacag

SEQ ID NO: 306825 - DNA, 439 bp, Homo sapiens
gtccctgaagaagctcttaaggtaacagtttttacttaacttcttttgcaaatctactcttcactatggttgattttacttcttgatgtttcacttccatttttaaatgttttatagcatgagaagtttaccattcagcttcagttgtcccaaaaatcttcagaatcagaattatccaaatctgcaagtgccaaaagcatagattcaaaggtagcagacgctgctactgaagtgcagcacaaaactactgaagcactgaaatccgaggaaaaagccatgggtaagctggcctctctcgaaagaccatctttatacttgatcttgaagacactgcatgctttgttctcagaaagttggctatgtccatataaaaataatttataatagtgataatttcagagtgtgttttaatgctaccagtgctttcattaggaaacat

SEQ ID NO: 306826 - DNA, 2905 bp, Homo sapiens
gcggcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaa

SEQ ID NO: 306827 - DNA, 1983 bp, Homo sapiens
gcggcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaa

SEQ ID NO: 306828 - DNA, 850 bp, Homo sapiens
  misc_feature (16)..(17): n is a, c, g, or t
  misc_feature (37)..(37): n is a, c, g, or t
aaatattgtctaggtnngaggctgggtgtttacagcnttcatggaggtgcagcgagacctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcagccaagactagaggctccaattaccagaaaaatcctgcaagacgggcaaagcgacaaagcgaagagcaaggagcaccgtcggggcgtgacca

SEQ ID NO: 306829 - DNA, 762 bp, Homo sapiens
ggggaggacagggttaggcacagccttgtacaaggacacatagcttgggcagcagaacttgggctggatttcagccctcactggtgccctttgggccagtgaacaacctgtgcagctgtacatggtggccctggaagccactgtggctcttgatcatgataagaccaaaaagagaacagaattggcagtgtcaagaggtgtctgaaccgggcacaatggcacatgcctatagtcatagctactcgggaggctgtggtgggaggatcgcttgagcccaggagtttgagatcagcccaggcaacataaaccctgtttcaaaaagaaaaaaggtccccccatttacatgtagttccctagagatgagaggtctgggatgctccttgcccgcggccaccccatggctgtgcctcctcactgtctgtgttttcctctctggcggggcgcggggcggcccctaggtgtccagccacatacaggttctagctcggaagaaggtgcgggagtaccaggttggcatcaaggccatgaacctggtgcctggcgggggccttcagccctcctgggcccctcacccacggcgctatctctgcatagctcaggcctttccttggccagctctccagccccactgtgcctcttttctggctgaagctctgtttctgcctctccttccgctctttctgttctttttctctttctttctctctctacaggtctctagccacttgcaagttctagccaggcggaaatctcgggagattc

SEQ ID NO: 306830 - DNA, 495 bp, Homo sapiens
tcccttgcagacgctgcagtgggttgacggcagccgctggaactttgcgtactgggctgctcaccagccctggtcccgcggtggtcactgcgtggccctgtgtaccgcgtgggtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagtaagttccccacacgaggtgctctcccttggcacctgcacctccactcaggagagctggggtccaactgtgtgtgtttgctttgggagggagggggttgcgacatctacaggagattgggacaggccaggaatagcccctttaccttgtacaatgttgcttccagatctctggcacaaaaccatagccaagccaggcgtggt

SEQ ID NO: 306831 - DNA, 2820 bp, Homo sapiens
cagggctattgaggtgggcatggcagttccttgcagagctggctgtcctgcagctgcggatctcagagtctggggttcatgactgaggcccttctgagggcctcacgctggccgtgtgctcttctccctgcccacagcggtgcagcagagggggcctcttacccccaggcccccatgcccagagcctagttccagaacatatggacagacccagagggcaccagcttgttttccctcactctgccctttccagggcttgccccagctggcaggcactccctctgtggggacggggagggtctgctgagcttccttgggctcctcggaagctaaaacccatgggcactgggtggaggtaggcgcaaagacgtccctcagcccacagccctggtgctgcacatgtcctctaatctatcttccttctctccctcacaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaa

SEQ ID NO: 306832 - DNA, 2906 bp, Homo sapiens
ggggaggacagggttaggcacagccttgtacaaggacacatagcttgggcagcagaacttgggctggatttcagccctcactggtgccctttgggccagtgaacaacctgtgcagctgtacatggtggccctggaagccactgtggctcttgatcatgataagaccaaaaagagaacagaattggcagtgtcaagaggtgtctgaaccgggcacaatggcacatgcctatagtcatagctactcgggaggctgtggtgggaggatcgcttgagcccaggagtttgagatcagcccaggcaacataaaccctgtttcaaaaagaaaaaaggtccccccatttacatgtagttccctagagatgagaggtctgggatgctccttgcccgcggccaccccatggctgtgcctcctcactgtctgtgttttcctctctggcggggcgcggggcggcccctaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaa

SEQ ID NO: 306833 - DNA, 2576 bp, Homo sapiens
tgctttggactctgctggggtcatgggaggggcgctaaagcaagcctggcctcatccagcgtggccctggcttcatgcagcctcctctccccaggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcgggtacatgggtcccaggaggtgggctggtgtgggggtgtgctgtaaaggatgagctttagtggggttcatggatgctgaggggcccctgggccttgtctcatccctgcagttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaa

SEQ ID NO: 306834 - DNA, 2989 bp, Homo sapiens
  misc_feature (1229)..(1229): n is a, c, g, or t
gcggcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggcgaccatctaagagccaccatcctagggcaggagccccggagagcctttcatcattgtgggtcatagcatcttcgatgtaacaaggcatcatgacgtcgaattagcgcactgacctcatccatgcgtcgtcgcgaccnaaggttgtggcatcccgtttggctaaagcagggttggttatgatgataaggctgagagacctgtagtactgcgctaggcgtggtaggaaacgggctgcattggatgttacgcgtgagtcacagcacggcctcgctcctactgtgtcgacgatacagtgagtcataggttcattccatgaaggcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaa

SEQ ID NO: 306835 - DNA, 2055 bp, Homo sapiens
  misc_feature (16)..(17): n is a, c, g, or t
  misc_feature (37)..(37): n is a, c, g, or t
aaatattgtctaggtnngaggctgggtgtttacagcnttcatggaggtgcagcgagacctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaa

SEQ ID NO: 306836 - DNA, 1165 bp, Homo sapiens
cttttggggtctttgctcttttgctgtctttgctcttttggggtctttgctctttcggggtctatcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaa

SEQ ID NO: 306837 - DNA, 1700 bp, Homo sapiens
gcggcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcagccaagactagaggctccaattaccagaaaaatcctgcaagacgggcaaagcgacaaagcgaagagcaaggagcaccgtcggggcgtgacca

SEQ ID NO: 306838 - DNA, 1691 bp, Homo sapiens
  misc_feature (1560)..(1560): n is a, c, g, or t
gcggcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagaatgagagactcggggagcagggaggggggaagagacgtgtgtgcaggaaacggggacgtggggagnggacctgcaggggcagccccctgaagtgccaagagagctgagaggagcagttgtgactctacccaggaacaaactgtgcctgaacctgaggtgcccaaccccaaataaacccaagatgctgtgtattttca

SEQ ID NO: 306839 - DNA, 1527 bp, Homo sapiens
gcggcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaa

SEQ ID NO: 306840 - DNA, 924 bp, Homo sapiens
cagggctattgaggtgggcatggcagttccttgcagagctggctgtcctgcagctgcggatctcagagtctggggttcatgactgaggcccttctgagggcctcacgctggccgtgtgctcttctccctgcccacagcggtgcagcagagggggcctcttacccccaggcccccatgcccagagcctagttccagaacatatggacagacccagagggcaccagcttgttttccctcactctgccctttccagggcttgccccagctggcaggcactccctctgtggggacggggagggtctgctgagcttccttgggctcctcggaagctaaaacccatgggcactgggtggaggtaggcgcaaagacgtccctcagcccacagccctggtgctgcacatgtcctctaatctatcttccttctctccctcacaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgccaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaa

SEQ ID NO: 306841 - DNA, 900 bp, Homo sapiens
cagggctattgaggtgggcatggcagttccttgcagagctggctgtcctgcagctgcggatctcagagtctggggttcatgactgaggcccttctgagggcctcacgctggccgtgtgctcttctccctgcccacagcggtgcagcagagggggcctcttacccccaggcccccatgcccagagcctagttccagaacatatggacagacccagagggcaccagcttgttttccctcactctgccctttccagggcttgccccagctggcaggcactccctctgtggggacggggagggtctgctgagcttccttgggctcctcggaagctaaaacccatgggcactgggtggaggtaggcgcaaagacgtccctcagcccacagccctggtgctgcacatgtcctctaatctatcttccttctctccctcacaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagtaagttccccacacgaggtgctctcccttggcacctgcacctccactcaggagagctggggtccaactgtgtgtgtttgctttgggagggagggggttgcgacatctacaggagattgggacaggccaggaatagcccctttaccttgtacaatgttgcttccagatctctggcacaaaaccatagccaagccaggcgtggt

SEQ ID NO: 306842 - DNA, 964 bp, Homo sapiens
gcggcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagaggatgatgagtacctggataaggtggagaggaacatcaagaaatccctccaggagcacctgcctgacgtggtggtatacaatgcaggcaccgacatcctcgagggggaccgccttgggggtctgtccatcagcccagcgggcatcgtgaagcgggatgagctggtgttccaggatggtccgtgtcaccgggtgcccatccttatggtacactcaggcgggatac

SEQ ID NO: 306843 - DNA, 242 bp, Homo sapiens
ctggtcccagttcctgtctgtctgtcccccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcgg

SEQ ID NO: 306844 - DNA, 3865 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306845 - DNA, 3906 bp, Homo sapiens
  misc_feature (3661)..(3661): n is a, c, g, or t
  misc_feature (3667)..(3667): n is a, c, g, or t
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaanaaacanaacaaacccacgcaaccagaatatacccgcccacaactaaacacaccacacacagcgccaacacacacacacacacacggcgcgccaacacaaaacccagcgacacacacaccaacgaccccacaagacccacagcactacaacacccaccacacaaacaccaacaacacagccgccccacacacaacaaacgcacccaacacaacaaccacaacaccaccaccacaccaccacaccac

SEQ ID NO: 306846 - DNA, 3816 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306847 - DNA, 3322 bp, Homo sapiens
gggaagattcgagacaaggaggaaggaattcagcctttgatgtagcgcagagccccagtcagccaagctgggtcagctgggaggcagctgtggtggggagagcctggagccttgggcagaagggaagagacagggaccccacctgatccaggctctcttcccacagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306848 - DNA, 3775 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306849 - DNA, 3826 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306850 - DNA, 3628 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306851 - DNA, 3826 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306852 - DNA, 4204 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306853 - DNA, 2493 bp, Homo sapiens
ttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306854 - DNA, 3715 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306855 - DNA, 2458 bp, Homo sapiens
  misc_feature (76)..(76): n is a, c, g, or t
  misc_feature (78)..(78): n is a, c, g, or t
  misc_feature (84)..(84): n is a, c, g, or t
  misc_feature (86)..(87): n is a, c, g, or t
ggcacgaggagagagagagagagagagagagagagagagagagagagagagagagagagagagagcgagcgccttnanctttgngnnggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306856 - DNA, 2215 bp, Homo sapiens
  misc_feature (14)..(14): n is a, c, g, or t
  misc_feature (23)..(23): n is a, c, g, or t
atgcatggtgtacncccggattntggatatgtcgaccacgcctcgctcctatgaccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306857 - DNA, 3820 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306858 - DNA, 3159 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306859 - DNA, 3405 bp, Homo sapiens
  misc_feature (3280)..(3280): n is a, c, g, or t
  misc_feature (3317)..(3317): n is a, c, g, or t
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccggagagctcggccgtcngttcgagccagtccgctcggccgctgtggggggggcnccccggttttggcccctttccccggagccgcggatgggtgcgccgcaggcctgcggtttctttccccggtcgctctctctccgggcgg

SEQ ID NO: 306860 - DNA, 3675 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306861 - DNA, 1568 bp, Homo sapiens
agaaggggacaacttacggctagtacgagcctgctgttaaatcggccgagggttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306862 - DNA, 1313 bp, Homo sapiens
caggctcatccctttgtcccggtggtcgcgagtccttgaagcatttcttccgctctccccaacgcagcatgcaggagaggcaaggggcccctccctcagctgtaggtggtccagctggtagccccagaccccctcgcctccggggcttgctgatgagaccctccagctacgctgcttgcaaaggggagaggcctgggaaagagctctatagaaaacattgggtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306863 - DNA, 1032 bp, Homo sapiens
tttttttttgagacggagtctcactctgttgcccaggctggagtacagtcgcgtcatctcggctcgctgcaacctcagcctcccgggttcacgccattctcctgcctcagcctcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306864 - DNA, 1538 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306865 - DNA, 2798 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcagggcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306866 - DNA, 1979 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306867 - DNA, 2121 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctgggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcgg

SEQ ID NO: 306868 - DNA, 578 bp, Homo sapiens
gagcgacaatgctacgaagacccaagacacaagagaaacaaaaaaaccacaacccaaaagactaacaaagctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306869 - DNA, 585 bp, Homo sapiens
cttgaggtcaggagttccagaccagcctggccaacatggtgaaactccgtctctactaaaaatacaaaaattagccgggtgtggtggggtgcgcttgtaatcccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306870 - DNA, 1511 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306871 - DNA, 1452 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtagcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306872 - DNA, 1272 bp, Homo sapiens
cgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctgtgagcgcgggactccgggcaccccacggctgggaggccggcgggccccacggggctcccccacccgggcctcaaccttcctttccttccttggcgtcccgactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcagggcacaggcttcacagtgattttgtgttcagccgtgagtcacactacatgcccccgtgaagctgggcattggtgacgtccaggttgtccttgagtaataaaaacgtatgttgcaaaaaaaaaaaaaaaaaaaaaaaaaaacaaaaacgcgtcgaggacgactatagctgcggcgggcgcgcaaaaaccgagcgcaggaacaggcaccgtgggccacacaggcgtgtcgccggaccccgatttccttgtccaccaggggcaaaaacggcgagccccccaataggggcgcgacaaaaagcgaaaagcgggggtaacgcggag

SEQ ID NO: 306873 - DNA, 98 bp, Homo sapiens
tctgaggaattcaggcctgaggccagggaggcagggtgctaggctgcgggctggggagccacagcatgaggctaagggagtgccatctccaccccagg

SEQ ID NO: 306874 - DNA, 412 bp, Homo sapiens
tagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcag

SEQ ID NO: 306875 - DNA, 383 bp, Homo sapiens
gtggaggctacagtgagctgtgatcaagccactgcactccagcctgggagacagttagaccctgtctcaaaaacaaatgaacaaacaaacaaaaaccctcaattcccacgaacgccccaggagataagggagcatggcccaggccttgagccagggcttctggcagtaggggagcctcccccatttgctaagcggactttcctcttccttctgtaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggc

SEQ ID NO: 306876 - DNA, 501 bp, Homo sapiens
gtcccagctactccggaggctgaggcaggaaaatcacttgaacccaggaggcggaggttgaagtgagccgagatcacaccactgcactccagcctgggcaacagagcaagactctgtctccaaaaataacaaaaaataaatacatgccttcctttctactgctgcacaacctcactgtgtcaggcaggcatctctggatccagctggtttttgttttgctgaggctcagcttcttcctggaactttttgaaacaacactcaagggtctcaagtgggtattttttcatgttgtatacccaaaaacctgaaaacccagggccctgggttacagtatttccacgtcgtatacccaaaaacctgaaaacctggggaccctgggttccagtatttcctggcgatcttacccactaccaccatctagtcaatttgaaccacctcctcaaccacctatgagggcctaaacactctttcactccctttcctgccagcacccctcaagct

SEQ ID NO: 306877 - DNA, 1042 bp, Homo sapiens
gtcccagctactccggaggctgaggcaggaaaatcacttgaacccaggaggcggaggttgaagtgagccgagatcacaccactgcactccagcctgggcaacagagcaagactctgtctccaaaaataacaaaaaataaatacatgccttcctttctactgctgcacaacctcactgtgtcaggcaggcatctctggatccagctggtttttgttttgctgaggctcagcttcttcctggaactttttgaaacaacactcaagggtctcaaatggctgacatgatggtctgtgacctgaaagttgttgaatagttggagtgttctgcattcatgtggaagaggctaaaggatgtttgatgaagcactatgggctgccctggaagaggactgaagaagcagctgcagggaatgaatgcttcaagaccacagtgctctcctgccttggaaacaccttcgccttcctccgcttctctttggctaccatggtcaccctccacactgctttcctcaactctcgggcaggctggtctcgaactcctgacctcatgtggtcctcctgcctcggcctcccaaggtgctgggattataggcatgagccactgcatctggcccgattctttatatttgtaaaaagcgtactgtacttcaatatattcaaaattagactattatttagaagtatatcaatttgcagccagggcagtggctcacgcctgtcctttacacatataagatggtaatacacggccgggcacagtggcttgtgcctgtaatcccagaactttggaaggccgaggtgggtggatcacctgaggtcaggagttcgaggaccagactggccaacatggagaaaccccgtctctgctagaaatgcaaaaattagccaggtgtggtggtgggctcctgtaatcccagctacttgggaggctgaggcaggagaatcccttgaacctgcgaggtagaggttgtagtgagccgaaattgcaccattgcactctagcctgggcaacaagagcgaaactttgtatcattaaataaata

SEQ ID NO: 306878 - DNA, 997 bp, Homo sapiens
agtgattcttctgcctcagactcccaagtagctgggattacaggcatgtgctaccactcccggattattttctatttttagtacagaccaggtttctccatgttggtcagactggtctcaaactccctacctcaagtgatctgcccacctcggcctcccaaagtgctgggattaaaggcgtgagtcaccacccctggccttatagtttatcttctagtggtcttctatcctcatttgaaaatgtgaaaagtgggtacctgagataattcaccgactcattgtttcttggaaccacaattgatctcagaagtgtaaccctgtactactgagaagcttaatcaaggacaaatacaatcccctcactccacagatggctgacatgatggtctgtgacctgaaagttgttgaatagttggagtgttctgcattcatgtggaagaggctaaaggatgtttgatgaagcactatgggctgccctggaagaggactgaagaagcagctgcaggaaagaaacgtccactctgctccagtcaaccccactgctggtgtcctctgcactgccttgcactccctgaagagagcctgggcaacagagcgagactccatctcaaaaaaaaaaaaaaaaaaaattggggactatgtatatagatttactacactgaagccctccagcagtctaagaactgatgcctctaacgaaggaaaggactgcatgtttctgatgaagctaccatgacctaccagatttccaacgcctgccaaaattaatctatttgtctgtggtagaagaggccataccattgtggcccttgaaacttactgtatgatgttttatttagtgaacagttcacatacccaaatggttgtaactgatactgctgaatatattgtaagaacagaagtgttaagtatgtataacacttcttttgattgtaaggaatgttcccagtggggaaatgccataattaaaacagtgatcgtgggatgaaaacatgat

SEQ ID NO: 306879 - DNA, 898 bp, Homo sapiens
gtcccagctactccggaggctgaggcaggaaaatcacttgaacccaggaggcggaggttgaagtgagccgagatcacaccactgcactccagcctgggcaacagagcaagactctgtctccaaaaataacaaaaaataaatacatgccttcctttctactgctgcacaacctcactgtgtcaggcaggcatctctggatccagctggtttttgttttgctgaggctcagcttcttcctggaactttttgaaacaacactcaagggtctcaaatggctgacatgatggtctgtgacctgaaagttgttgaatagttggagtgttctgcattcatgtggaagaggctaaaggatgtttgatgaagcactatgggctgccctggaagaggactgaagaagcagctgcaggaaagaaacgtccactctgctccagtcaaccccactgctggtgtcctctgcactgccttgcactccctgaagagagcctgggcaacagagcgagactccatctcaaaaaaaaaaaaaaaaaaaattggggactatgtatatagatttactacactgaagccctccagcagtctaagaactgatgcctctaacgaaggaaaggactgcatgtttctgatgaagctaccatgacctaccagatttccaacgcctgccaaaattaatctatttgtctgtggtagaagaggccataccattgtggcccttgaaacttactgtatgatgttttatttagtgaacagttcacatacccaaatggttgtaactgatactgctgaatatattgtaagaacagaagtgttaagtatgtataacacttcttttgattgtaaggaatgttcccagtggggaaatgccataattaaaacagtgatcgtgggatgaaaacatgat

SEQ ID NO: 306880 - DNA, 501 bp, Homo sapiens
gtcccagctactccggaggctgaggcaggaaaatcacttgaacccaggaggcggaggttgaagtgagccgagatcacaccactgcactccagcctgggcaacagagcaagactctgtaaaaaaaaaaaaaaaattggggactatgtatatagatttactacactgaagccctccagcagtctaagaactgatgcctctaacgaaggaaaggactgcatgtttctgatgaagctaccatgacctaccagatttccaacgcctgccaaaattaatctatttgtctgtggtagaagaggccataccattgtggcccttgaaacttactgtatgatgttttatttagtgaacagttcacatacccaaatggttgtaactgatactgctgaatatattgtaagaacagaagtgttaagtatgtataacacttcttttgattgtaaggaatgttcccagtggggaaatgccataattaaaacagtgatcgtgggatgaaaacatgat

SEQ ID NO: 306881 - DNA, 265 bp, Homo sapiens
gctaccatgacctaccagatttccaacgcctgccaaaattaatctatttgtctgtggtagaagaggccataccattgtggcccttgaaacttactgtatgatgttttatttagtgaacagttcacatacccaaatggttgtaactgatactgctgaatatattgtaagaacagaagtgttaagtatgtataacacttcttttgattgtaaggaatgttcccagtggggaaatgccataattaaaacagtgatcgtgggatgaaaa

SEQ ID NO: 306882 - DNA, 595 bp, Homo sapiens
caagagcaaaactctgtctcaaaagaaaagaagaaaaaaagtttgtagatgctgagcagaaggcaacttaaatctgaaagtaagtccaaaactgtgcttattggtgtggaactgctcctgtcacacccccgatctcttcctctctcttaccctgacctctgttcctttaaggaaagaaacgtccactctgctccagtcaaccccactgctggtgtcctctgcactgccttgcactccctgaagagagcctgggcaacagagcgagactccatctcaaaaaaaaaaaaaaaaaaaattggggactatgtatatagatttactacactgaagccctccagcagtctaagaactgatgcctctaacgaaggaaaggactgcatgtttctgatgaagctaccatgacctaccagatttccaacgcctgccaaaattaatctatttgtctgtggtagaagaggccataccattgtggcccttgaaacttactgtatgatgttttatttagtgaacagttcacatacccaaatggttgtaactgatactgctgaatatattgtaagaacagaagtgttaagtatgtataacacttcttttg

SEQ ID NO: 306883 - DNA, 1328 bp, Homo sapiens
cagacttgccacaggaaatgagccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtatggtaggctggggaggagatgcagcaaggtggggaattaaggatcacaaagaagggcaggaagggaagagaagtccctccactgaacacctgctgtgctctgggccaagtgcctttgctgatcactacgaataggagagttcaagactgctaactttagttttttagatgataaaactaggactgagagagggcaagtaacttgtccaaggtcccccaggtaagtaagcaggtaggagagttagactttaaactcatccctgtgtgactccaaaggctctttctactgtgactccaaaagctctttctactgtggttccaatcaaaagtcaactaatttctgacttcagactcttgatacccagacaccccttgcctcccaggccagaagcagaccttgcaggtgccactgtagtcaccattttgaaccttgtgtgtaggctgatgaaaacattcagagccctcctgcccacctcaaacaaaaagtcctctcgagagaactagcaaagctggttcacaaggtctgtcaggacagaattatccagcacatgccttcccacaatatttttttaacagtgagatttttccagtatcaagaatacagtctcttcagctcaccacagggcctactattccagagccgttttcagccaggtgcccaaagtgcaccctcatttaatcttcatcccttaaatgcttggcgtttcctttcaaagtatggctttccaactaccttaaattcagacacatttccttaaggaatcttctcagaaatctcaccctctgatctccagagtccagtctcttcagcaccatagcaccccaaaccccggcctggccctccgcatttagtctactctgactctttttccaaagcaaccaattgcttttgagtctccagcaccataa

SEQ ID NO: 306884 - DNA, 555 bp, Homo sapiens
acctgacagctcactgctcagattacttttctaaaatgagatgggagagaaacagatgtttgctctttccaagaaattgatacacatgctgatttctgtgccttttttacttgttctttccgtagaatgtacaccctccactctaacaccctactctaaccatccttgaacacctatgtaacatcacctttatcagaaaacttctcagccagatacagaaatcattccaatgacctgacctgtgttcacacagaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtatggtaggctggggaggagatgcagcaaggaggaggaggaattcgcccaggaggaggaggaattcgcccaggaggaggaggaattcgcccaggaggaggaggaattcgcccaaggaggaggaggaaattcgccca

SEQ ID NO: 306885 - DNA, 428 bp, Homo sapiens
cctatgtaacatcacctttatcagaaaacttctcagctagatacagaaatcattccaatgacctaacctctgctcacacagaactccagaacaagatcaagctgacagtgctggaaggagacattctggatgagccattcctgaagagagcctgccaggacgtgtcggtcgtcatccacaccgcctgtatcattgatgtcttcggagtcactcacagacagtctatcatgaatgtcaatgtgaaagctcctgttggaggcctgtgtccaagctactgtgccagtcttcatctacaccagtaccctccagttagccgggcccaactcctacaaggaaatcattgagaatgcccatgaagaagactttctggaaaacacatggtctgctccatatccatacagcaaaaagcttgctgagaaggctgtgct

SEQ ID NO: 306886 - DNA, 1705 bp, Homo sapiens
cagacttgccacaggaaatgaggtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtggagggaggtgtga

SEQ ID NO: 306887 - DNA, 2158 bp, Homo sapiens
cagacttgccacaggaaatgaggtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgacaaaaaaaaaaaaaaaaaaaaaaaaaaaaaaaaaaaaaaaaaaaaaaaacaaaaaaaaaaacagacaagagagagagagaagagagagaagagaaagaaaaagaaagaagacaaacaagaacaagacaaaaaagagggagcgaggaggcgacaccagaaagacgcagcaacaaagggagagaggggagagcgcgggcgcggggggagaaggacaggagaggaagagaacaaaatagaggctacggaatggagctatcgcggggcgaaggagaaagacaaacggggggcgaggtagaaaaaaaaagaatgggtaacaagatgaaaaaaaacaaatatcccggagacagaagctagtagcgggaaggacgatcaaggagaggtgaactacaaagacatgaggatgataaaaagacaaggggagaggatgacgagaaagggagcaaacgaacacgtcgaaatggagagaaagataag

SEQ ID NO: 306888 - DNA, 1707 bp, Homo sapiens
gtttgcaaaaaaaatggggtggaggaaaatgaggcatctgtgtgagtatataaccatttgacatctctttttagccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtggagggaggtgtga

SEQ ID NO: 306889 - DNA, 1738 bp, Homo sapiens
tattgaagagtttatattgcctatatacaatggtgtatgtgtgtgtgtgatgtgaattcttcaactgcccattttgcctaaggactggaactgtccatattcacagagtatagcctcctgattttttagattttaaatgatctgactttaatggtactgattacaaatcataatttgtcaatacccttacttggcaaaataaaaagtgataaccctaggtccctttccaaaattaaagtacacacacacacacatccatgaaacccaaaagtctagaaattcttactctccagaacccacatgtcagtttctcttcattttggtatttttcttatggctgtagtacgaccaaatctcagacagaaccacagaagaatgtaccctgagtctgttacaaccaccatatttgggagtggggggtggggcacatagatctgtgttcgtggttggcacctcttagggatatatcctgacagtgacaatatgctcttcatggacaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtggagggaggtgtga

SEQ ID NO: 306890 - DNA, 1467 bp, Homo sapiens
acgatctaagacgaagaggggataggtctgtaaggctcggacagaattgagtgaggaatttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggaccccaagaaggccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtggagggaggtgtga

SEQ ID NO: 306891 - DNA, 918 bp, Homo sapiens
cagacttgccacaggaaatgaggtgagaagtacgtccactcttctgtccagcttttaacaatctaactaatgccctctccagggtcaccctagaatcagatctgctccccaagcatccgaggacagttctactatatctcagatgacacgcctcaccaaagctatgataaccttaattacaccctgagcaaagagttcggcctccgccttgattccagatggagctttcctttatccctgatgtattggattggcttcctgctggaaatagtgagcttcctactcaggccaatttacacctatcgaccgcccttcaaccgccacatagtcacattgtcaaatagcgtattcaccttctcttataagaaggctcagcgagatttggcgtataagccactctacagctgggaggaagccaagcagaaaacggtggagtgggttggttcccttgtggaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtggagggaggtgtga

SEQ ID NO: 306892 - DNA, 1034 bp, Homo sapiens
  misc_feature (862)..(862): n is a, c, g, or t
  misc_feature (865)..(865): n is a, c, g, or t
  misc_feature (965)..(965): n is a, c, g, or t
  misc_feature (1016)..(1016): n is a, c, g, or t
cagacttgccacaggaaatgaggtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggagtctcactgttatcagtttgtgcatgtgctggcacattgctgaggctgcagaccaanagnccagctcgagaagtctctttctcgatgcacgctcacaagtatgtactatacactggcagagtcgctcgctgatcagtgagcttctttctgtgtttgttgntctgtgtatatggcttcatctgcattcacatcgacgcctcacgcactagtncatgtcatacgtttactt

SEQ ID NO: 306893 - DNA, 767 bp, Homo sapiens
cagacttgccacaggaaatgaggtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctagaccggcacaaggagaacctgaagtccaagactcagtgatttaaggatgacagagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtggagggaggtgtga

SEQ ID NO: 306894 - DNA, 441 bp, Homo sapiens
tacaatcgagctcggcccagttttacatgagatgtgcatgtgggtattgttaggagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtggagggaggtgtga

SEQ ID NO: 306895 - DNA, 683 bp, Homo sapiens
cagacttgccacaggaaatgaggtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctaaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgcacatccgtactggcccgccttcaccccaagtgtctgacaccgtatgcccgcacatccgtactggcccg

SEQ ID NO: 306896 - DNA, 1329 bp, Homo sapiens
acctgacagctcactgctcagattacttttctaaaatgagatgggagagaaacagatgtttgctctttccaagaaattgatacacatgctgatttctgtgccttttttacttgttctttccgtagaatgtacaccctccactctaacaccctactctaaccatccttgaacacctatgtaacatcacctttatcagaaaacttctcagccagatacagaaatcattccaatgacctgacctgtgttcacacagaactccagaacaagaccaagctgacagtgctggaaggagacattctggatgagccattcctgaagagagcctgccaggacgtctcggtcatcatccacaccgcctgtatcattgatgtcttcggtgtcactcacagagagtctatcatgaatgtcaatgtgaaaggtatggtaggctggggaggagatgcagcaaggtggggaattaaggatcacaaagaagggcaggaagggaagagaagtccctccactgaacacctgctgtgctctgggccaagtgcctttgctgatcactacgaataggagagttcaagactgctaactttagttttttagatgataaaactaggactgagagagggcaagtaacttgtccaaggtcccccaggtaagtaagcaggtaggagagttagactttaaactcatccctgtgtgactccaaaggctctttctactgtgactccaaaagctctttctactgtggttccaatcaaaagtcaactaatttctgacttcagactcttgatacccagacaccccttgcctcccaggccagaagcagaccttgcaggtgccactgtagtcaccattttgaaccttgtgtgtaggctgatgaaaacattcagagccctcctgcccacctcaaacaaaaagtcctctcgagagaactagcaaagctggttcacaaggtctgtcaggacagaattatccagcacatgccttcccacaatatttttttaacagtgagatttttccagtatcaagaatacagtctcttcagctcaccacagggcctactattccagagccgttttcagccaggtgcccaaagtgcaccctcatttaatcttcatcccttaaatgcttggcgtttcctttcaaagtatggctttccaactaccttaaattcagacacatttccttaaggaatcttctcagaaatctcaccctctgatctccagagtccagtctcttcagcaccatagcaccccaaaccccggcctggccctccgcatttagtctactctgactctttttccaaagcaaccaattgcttttgagtctccagcaccataa

SEQ ID NO: 306897 - DNA, 1051 bp, Homo sapiens
cagacttgccacaggaaatgaggtgagaagtacgtccactcttctgtccagcttttaacaatctaactaatgccctctccagggtcaccctagaatcagatctgctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctagtaagtaaacttgggtcatgggtgtgtggttccatcttaaacactgcatgtatgtggggggagatggaccttgtctagcaagttattgaaatttgtagccaaatctaagccaatctcacatccaaagtcatcaagaaataaatattaaatagtataaaatggcatagtatgaaagatactgggtgggatttccagagactagattctggccctgacccagaacttgagaagcagccacctcagcctccaggcctcttttcttctcatctagaaaatcccacatcagttctttgtcttgtctgcaactcttttatgttctgaagcttttgtcttggcaattgctgtacaacattcataaaggacactattaccctggagacctcaccaatgggtcattgtctctctagaacgtgccaggctgtgttttgttttgcagcttccttagtatcctttgtgagggcaaaataaaaggaagttaaggtaaagatgagtgtataagtgggtgtgtgtgacagagagagaggaaaacaataagggggagagagagtcggggagagagagtcggggagagagactcagagagagagacaatgagaaagacagagaaataatgaaaaatatatagtgagagagagagcatcagtgagagaatgtgtgtgcacagtgcacagcacagagcagagacagagtaagaggcagtataaggccagacatgcctcatttagattttgcatatatggctttttttt

SEQ ID NO: 306898 - DNA, 519 bp, Homo sapiens
  misc_feature (18)..(18): n is a, c, g, or t
  misc_feature (74)..(74): n is a, c, g, or t
  misc_feature (80)..(81): n is a, c, g, or t
  misc_feature (87)..(87): n is a, c, g, or t
  misc_feature (89)..(89): n is a, c, g, or t
  misc_feature (91)..(91): n is a, c, g, or t
  misc_feature (103)..(104): n is a, c, g, or t
  misc_feature (106)..(106): n is a, c, g, or t
  misc_feature (114)..(116): n is a, c, g, or t
  misc_feature (134)..(134): n is a, c, g, or t
  misc_feature (152)..(153): n is a, c, g, or t
  misc_feature (155)..(157): n is a, c, g, or t
  misc_feature (159)..(159): n is a, c, g, or t
  misc_feature (165)..(166): n is a, c, g, or t
  misc_feature (184)..(184): n is a, c, g, or t
  misc_feature (188)..(188): n is a, c, g, or t
  misc_feature (191)..(191): n is a, c, g, or t
  misc_feature (194)..(194): n is a, c, g, or t
  misc_feature (200)..(202): n is a, c, g, or t
  misc_feature (208)..(209): n is a, c, g, or t
  misc_feature (211)..(213): n is a, c, g, or t
  misc_feature (221)..(221): n is a, c, g, or t
  misc_feature (227)..(228): n is a, c, g, or t
  misc_feature (231)..(231): n is a, c, g, or t
  misc_feature (233)..(233): n is a, c, g, or t
  misc_feature (235)..(238): n is a, c, g, or t
  misc_feature (242)..(244): n is a, c, g, or t
cgtaacagcccaccaacnaaacaacaaaaaccgccacgcccggccggaaaggcgccaaaccaaaaaccacaacngcaacnnaaatangnangcagggaaccannanacacagcnnnagcgcccgaggtggatcnacagcgaagtaaaccgtnnannngntgcctnngaagaaacaaacgcaaancccnaanacngaaccnnngcagcnngnnngggaaganaagccnnaangnannnnaggnnncatcaaaacctgcgcagtcattggcccaacaagaaggtttctgtcctaatcatataccagaggaaagaccatgtggtttgctgttaccaaatctcagtagctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtggagggaggtgtga

SEQ ID NO: 306899 - DNA, 1363 bp, Homo sapiens
aggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgttaaaaaaa

SEQ ID NO: 306900 - DNA, 2237 bp, Homo sapiens
aggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggtaatgtttcattccagagatttagccacaaaggaaagaactttgaggccatggtagctgagccaaagaaccaatcttcagaattttaaataccctgtcacaatactggaaataattattctccatgtgccagagctcccatctcttctctttcagttcattaattaattaattaattcatgtaaaatccatgcatacctaaccatagctaatattgtgcacttataattcaagagggctctaagagttaattagtaattgtaactctctataacatcatttaggggagtccaggttgtcaatcggtcacagagaaagaagcatcttcattcctgcctttcctcaatatacacaccatctctgcactacttcctcagaacaatcccagcagtctgggaggtactttacacaatttaagcacagagcaactgcctgtccctgctgctagtttaaacatgaaccttccaggtagcctcttcttaaaatatacagccccagctgggcatgatggctcatgcctgtaatcctagcactttgggaggctgaggcgggtggattacttgaggtcaggagttcgagaccaccctggccaacatggtgaaaccccatctctagtaaaaatacaaaaattagctgactttggtggcacatgcctgtaatcccagctacttgggaagctgagacagaagagtcacttgaacctgggaaacagaggttgcagtgagccaagatcgcaccactgcactccaccctggatgacagactgaaccccatctcaaaaaattaaaataaaataaaataaaataactatatatatagccccagctggaaattcatttctttcccttattttacccattgttttctcatacaggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgttaaaaaaa

SEQ ID NO: 306901 - DNA, 1580 bp, Homo sapiens
aggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatggtaaaaacttgagccctccttgttcaagaccctgcggtaggcttgtttcctattttgacattcaaggtaaatacaggtaaagttcctgggaggaggctttatgtgagagtacttagagcaggatgctgtggaaagtggtttctccatatgggtcatctaggtaactttaagaatgtttcctcctctcttgtttgaattatttcattctttttctcagttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgttaaaaaaa

SEQ ID NO: 306902 - DNA, 1478 bp, Homo sapiens
aggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggggagtccaggttgtcaatcggtcacagagaaagaagcatcttcattcctgcctttcctcaatatacacaccatctctgcactacttcctcagaacaatcccagcagtctgggaggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgttaaaaaaa

SEQ ID NO: 306903 - DNA, 2454 bp, Homo sapiens
aggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggtaatgtttcattccagagatttagccacaaaggaaagaactttgaggccatggtagctgagccaaagaaccaatcttcagaattttaaataccctgtcacaatactggaaataattattctccatgtgccagagctcccatctcttctctttcagttcattaattaattaattaattcatgtaaaatccatgcatacctaaccatagctaatattgtgcacttataattcaagagggctctaagagttaattagtaattgtaactctctataacatcatttaggggagtccaggttgtcaatcggtcacagagaaagaagcatcttcattcctgcctttcctcaatatacacaccatctctgcactacttcctcagaacaatcccagcagtctgggaggtactttacacaatttaagcacagagcaactgcctgtccctgctgctagtttaaacatgaaccttccaggtagcctcttcttaaaatatacagccccagctgggcatgatggctcatgcctgtaatcctagcactttgggaggctgaggcgggtggattacttgaggtcaggagttcgagaccaccctggccaacatggtgaaaccccatctctagtaaaaatacaaaaattagctgactttggtggcacatgcctgtaatcccagctacttgggaagctgagacagaagagtcacttgaacctgggaaacagaggttgcagtgagccaagatcgcaccactgcactccaccctggatgacagactgaaccccatctcaaaaaattaaaataaaataaaataaaataactatatatatagccccagctggaaattcatttctttcccttattttacccattgttttctcatacaggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatggtaaaaacttgagccctccttgttcaagaccctgcggtaggcttgtttcctattttgacattcaaggtaaatacaggtaaagttcctgggaggaggctttatgtgagagtacttagagcaggatgctgtggaaagtggtttctccatatgggtcatctaggtaactttaagaatgtttcctcctctcttgtttgaattatttcattctttttctcagttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgttaaaaaaa

SEQ ID NO: 306904 - DNA, 1358 bp, Homo sapiens
aggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggttataagcacatgtccttggccctgaataggactggcagaagcattgtgtactcctgtgagtggcctctttatatgtggccctttcaaaagagctccacactatttggaagtatttgttgacttgttaccatgtctccccactagagtcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaaaatgttaaaaaaa

SEQ ID NO: 306905 - DNA, 747 bp, Homo sapiens
gaagccaaggtggaggtctagtcgaaaagaaggctcatcagagaagtctaactaaagtttggtcaagaagagtctttgtcaaggtaaatctatcatttccctcaaaaggtaattttcaggatcccatcaggaagattagcatggctgctagctttctcctcagttctgggctatagctcacatgcctagtttgaactagctcagcagaactgggggatttattctttgtcttccaacaaactcatctggatgattttgggggtttgtggggaaaagcccccaatacctggtgaagtaaccttgtctcttcccccagcctggaatggttctctctttctgctacctcacgattgtgcttctacaatggtgactcttttcctccctctcatttcaggttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggtaatgtttcattccagagatttagccacaaaggaaagaactttgaggccatggtagctgagccaaagaaccaatcttcagaattttaaataccctgtcacaatactggaaataattattctccatgtgccagagctcccatctcttctctttcagttcattaattaattaatta

SEQ ID NO: 306906 - DNA, 157 bp, Homo sapiens
ctaaccaggtaatgtcagtgtgaggtcacatacaatgtgtgtgtttctgccctgcatttggctcagagccacttgtaataattttttgctgttgaggtttccttgatacttctctgaagtcactttttctttttttctttttctttttttttttttt

SEQ ID NO: 306907 - DNA, 829 bp, Homo sapiens
ttctacctgtcatttgtaaataaattgtaaaattaggtaaataatatatttacccagtgagtggttaacatttttataacttttaccaattaatgtattttagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaag

SEQ ID NO: 306908 - DNA, 972 bp, Homo sapiens
caagaggggaaaaggcaaaccctaaaagtgctgcagaccttaaaaaacttagccacagggtggatgtcacttgagtttacagtttatattttgctggtggaagtgttttctgggtgctgtcagttgactctggttgttcacttggataaacgaagaggttagtgcagaacaatttgatccatatgcatttcattttcgattttcaagtttacatttctgttttctcctaaagctctccatgttttattggggaccatctgatgatttttgcaaagcgatgatggtagtgtgtgcttaaatgcttgtgctagtctccactctcaaaacgtggaccatccctctagggcaagtaactcctaatcactgcacccaggaaccagctccactgaagaaacacaagcgctccttgacctaggatttctttaggagttttcaggccaacctccacttatcctaagataatttcccctctttttaggaaagttgcacgccgccaggcttggaggttgctgcttggtgcagtttactcatgttggcaaagacttcatagttaaacgccctccatttacctgaagttatcttgcctttcatttcattagttaatcagatattttatgccaccctagatgttttattgggttctagttgcttaaaaactttaactgtattattgcaatatcattaaaatgttgcacaaagagtaattctactgtatatagccctggaaggtgagaactctattcagtttaggattcttgagaggataagtgaggtaatcagaggttccattcctggctttacattaactagctgtgtgatacatctcggtgcctcgatttacccatctgtaagatagggccattagtaccttgcagggttatgggagggtggaggaaattacaagaaattgtgtaaagaaaaatcccacttagttcataataagtattcagtatttggtagctatcattatat

SEQ ID NO: 306909 - DNA, 836 bp, Homo sapiens
gtttgataactttctacatgtggcacattctcttaagtgctgtacacatgttatctcattcaaatctcttaacaatctcatgaagcgggaattgttattatcctaatcttagattttggaaagtgcttggcacatagtaggttcttaatctgagttagcttccttccttcctaaaggtttaacactttctgttatatctagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggtatggaatttgtgtattttttccttatacaactgtaagacacatttctttcatctctgaattttaaaattatcttttattattatagaagcaaaagcatggcaaaaaattagaaaatacagaaaaattaaaataaaaaattggccaggtgcagtggcccatgcctgtaatcccaggacttagggaagccaaagtgggtagattgcttgagcctgggagttcgagaacagccttggcaaaagggtaaaaccctctctctacaaaaaaatacaaaaaattagcttggcatggtggcaagcacctgtatttccagctactccggaggccaaggctgcggtgagctgtgatcatgtgactgcactgcagcctgagtcacagggtgagactctggcttaagaaaataaaaaaaaaaatttaaaaatcacatttccactacttagaggccatgattctgaattgtagcttata

SEQ ID NO: 306910 - DNA, 412 bp, Homo sapiens
ttctacctgtcatttgtaaataaattgtaaaattaggtaaataatatatttacccagtgagtggttaacatttttataacttttaccaattaatgtattttagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttagtatccttttttgttcagttttagcacagatttaatgtctatctatggaagtaaaaaaatagcctcatatgtgtagattttactcatttaccatagatagacattaagtct

SEQ ID NO: 306911 - DNA, 10452 bp, Homo sapiens
  misc_feature (1579)..(1579): n is a, c, g, or t
gcctccaccctccaccctcctccctccctctctccccggcgcgggcgagtgtctgcggcgcggcggccaggaaatgccgcagatgcgccgcgcagcatccccggtgaaggcagcgcgccggtcctcccgcaccgctgccgcggcctcggcccggcccgaagcacgcgcctcgtgcagggccagcagagcggtcagcgcggccgcagagggtccgggcgcccgccggcccccgcccgccctcgccgcacgccccgctcctccgcttggcgtggcgctgctcgtcgccgcccctgggctcgctgagatttgccgctgctgaaacccgagagggactcgggctcccggagccgggcggcccaccatcggcctgcccggaggcctgggcgtttcctttgccggccctggcgccggcagccccctgcgcccccgctctgcgtcttcggcttccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgnctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaat

SEQ ID NO: 306912 - DNA, 10353 bp, Homo sapiens
  misc_feature (1480)..(1480): n is a, c, g, or t
tgaagaggatggtcataaagtctgtgtggaacagatgtcagagtggaattttcagacttaatggagaggatctaagtaagctctggattttgaaatgagtgaatctatggagctgtgatctcctacaaatcaaatggggaatgtctgtggatgtgtaagagctgagaaagaagaacaatatgtagatcctgccaaaactcctttgaaccctgaaaaatactctcctggaagaaaatatttcagaagaaaaccgatcaaaaaaactggaggtgacaaagagtcagttggggcaaacaatgaaaatgaaggcaagaagaagagcagcagtcagccttcaaaagaacagccagctcctttatccaggggactggtacagcaggaatctgttaccctaaactctgcactgggagatggtattcagcaaaagaagacagaagttgtagctgacagcgttaaacagaaacttctgccgagtgctgtaagcagttggtctgactgtgtgaacacttctcctgctaaagacagtgaaacagaagtaaaagttagtgaactggatgaaaggatttcagaaaaagacagcactccatattgcgcaaagaggaagaaacatttagatgatgtcaacacaagcgaaataacattccaggaaaaaactgatgttttttctttccgaaaggcagccagcttaagctctattccctcgggtatagaaagatcactcgaaaaaagtgggtttcctgaagacccaccaaaaagttatagcagtattcaagaaaagcaaaacactgagagattttgccctcatgcaacacagcattttcagtttaaaaaaaagagatgccattccctttatactagtatgtcctctgtttctaaggacacagatggaaatgagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgnctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaat

SEQ ID NO: 306913 - DNA, 7611 bp, Homo sapiens
tagtcactggacgatatattacaacatctatcgtatctagaaaatcactccaggccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaat

SEQ ID NO: 306914 - DNA, 8127 bp, Homo sapiens
  misc_feature (1579)..(1579): n is a, c, g, or t
gcctccaccctccaccctcctccctccctctctccccggcgcgggcgagtgtctgcggcgcggcggccaggaaatgccgcagatgcgccgcgcagcatccccggtgaaggcagcgcgccggtcctcccgcaccgctgccgcggcctcggcccggcccgaagcacgcgcctcgtgcagggccagcagagcggtcagcgcggccgcagagggtccgggcgcccgccggcccccgcccgccctcgccgcacgccccgctcctccgcttggcgtggcgctgctcgtcgccgcccctgggctcgctgagatttgccgctgctgaaacccgagagggactcgggctcccggagccgggcggcccaccatcggcctgcccggaggcctgggcgtttcctttgccggccctggcgccggcagccccctgcgcccccgctctgcgtcttcggcttccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgnctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagaggtatactctgtgttctgagaccttatcagctacctaatgtcaagtttcctcatttgtttcctttctctcctagactaaatttttaaaacaattttgaatgtgattggctcattgtagttctgacaggaaaataatgctatactctttctggtaacttacttgaatctttatcataaattaactttaatttttgaatgtttgagattaaacatacagatgtaatagatatactgttatatctgtggagatacattctgaaaaatgtgagtatcaaaaaagctagaagaaccaagcagttagctttaacttctaacatattctgtggctagattttgtcttagtcttttttaaagatataattttaatacctttaattgtcatctaagataaaattcagactctgaaaataatataatacttattcctgaaccctccttggtttgaaatttttcttcttttcactaatcttgtctttgtaattcaaagaattatgtttggattgagaatggataaagtgacat

SEQ ID NO: 306915 - DNA, 2994 bp, Homo sapiens
  misc_feature (1579)..(1579): n is a, c, g, or t
gcctccaccctccaccctcctccctccctctctccccggcgcgggcgagtgtctgcggcgcggcggccaggaaatgccgcagatgcgccgcgcagcatccccggtgaaggcagcgcgccggtcctcccgcaccgctgccgcggcctcggcccggcccgaagcacgcgcctcgtgcagggccagcagagcggtcagcgcggccgcagagggtccgggcgcccgccggcccccgcccgccctcgccgcacgccccgctcctccgcttggcgtggcgctgctcgtcgccgcccctgggctcgctgagatttgccgctgctgaaacccgagagggactcgggctcccggagccgggcggcccaccatcggcctgcccggaggcctgggcgtttcctttgccggccctggcgccggcagccccctgcgcccccgctctgcgtcttcggcttccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgnctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggtaaagctggaaagtgtaatggtgttggttgaatattgatatgattatttcccttcagattcttttattgctgagaagttgaa

SEQ ID NO: 306916 - DNA, 2064 bp, Homo sapiens
tggtgttctagaggatctcggaagcacacgcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaat

SEQ ID NO: 306917 - DNA, 591 bp, Homo sapiens
gtcatgagtcactcggtaggtgaagaacaaggagttaaatgaagtctcatttatctcttttctccccagatgctgttttgagatcgcaccactttcgttctgaggtaatttatttagcgcgcacgctcaaggtcagaagaagttctctttcctgagtaccaatattaattatatgcgtgttaagaaaccagtaggacactgaatgacgaacatgctgtcccctagccgaaagtggcatgtttccttttaagtgatttcatattagtgcccagcgaacggttttagcaaatttcttgtgtagtggagctgttgtacaagaggggaaaaggcaaaccctaaaagtgctgcagaccttaaaaaacttagccacagggtggatgtcacttgagtttacagtttatattttgctggtggaagtgttttctgggtgctgtcagttgactctggttgttcacttggataaacgaagaggttagtgcagaacaatttgatccatatgcatttcattttcgattttcaagtttacatttctgttttctcctaaagctctccatgttttattggggaccatctgatgatttttgcaaagcg

SEQ ID NO: 306918 - DNA, 8996 bp, Homo sapiens
gagctgccacttttcaccgttagaagtagagctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaat

SEQ ID NO: 306919 - DNA, 1146 bp, Homo sapiens
tgaagaggatggtcataaagtctgtgtggaacagatgtcagagtggaattttcagacttaatggagaggatctaagtaagctctggattttgaaatgagtgaatctatggagctgtgatctcctacaaatcaaatggggaatgtctgtggatgtgtaagagctgagaaagaagaacaatatgtagatcctgccaaaactcctttgaaccctgaaaaatactctcctggaagaaaatatttcagaagaaaaccgatcaaaaaaactggaggtgacaaagagtcagttggggcaaacaatgaaaatgaaggcaagaagaagagcagcagtcagccttcaaaagaacagccagctcctttatccaggggactggtacagcaggaatctgttaccctaaactctgcactgggagatggtattcagcaaaagaagacagaagttgtagctgacagcgttaaacagaaacttctgccgagtgctgtaagcagttggtctgactgtgtgaacacttctcctgctaaagacagtgaaacagaagtaaaagttagtgaactggatgaaaggatttcagaaaaagacagcactccatattgcgcaaagaggaagaaacatttagatgatgtcaacacaagcgaaataacattccaggaaaaaactgatgttttttctttccgaaaggcagccagcttaagctctattccctcgggtatagaaagatcactcgaaaaaagtgggtttcctgaagacccaccaaaaagttatagcagtattcaagaaaagcaaaacactgagagattttgccctcatgcaacacagcattttcagtttaaaaaaaagagatgccattccctttatactagtatgtcctctgtttctaaggacacagatggaaatgaggtaagtgaaatgtggagtctgagttcaagtaaataagtgttccaggtgctcacatcagactgacatctaatttgtcttttataaagttattttcatattagtgtatgtaaaagccatagagtttctgttgcgttttgttagtagcctcaggtttgattgttatgattttatttttgtgctgtgcacattctttgaccacactttaatctaaaaatcctgtacattttcattattggtggaagactttaaaa

SEQ ID NO: 306920 - DNA, 10772 bp, Homo sapiens
  misc_feature (1899)..(1899): n is a, c, g, or t
ggcggccgcggcggcggcgctgctcctccccactcgccgcgtccccggcggggctgcgcccgggggctgcgcacggacgggggcgggggcgcctggggagggaggggagaggatcccagccgccgagtcgcagcctcgtcgctgtctgctgagtcatggcaagcgctccccgcagccctggatcactcgcgtagcgcggctggcgcggggtgcgcagccattgggctgggcgcggggccgcgagcgccaggcatgacgcgctgagccgcgctcacccgtgcccgccgtcccggcgtgcgcccagcgcgggtgcctgtgccgccgccctccagccccgccgtcgagtcgccctcgcctcgcccgcaccatgatcgccgcggctttcctcgtcttgctgagaccctacagcatccaatgtgccctcttcctcttgttgcttctgctgggcaccatcgccaccatcgtcttcttctgctgctggcaccgcaagctccagaaagggaggcatccgatgaaatcgtcttctcgggtcgttcaagaagccgagatgctgttttgagatcgcaccactttcgttctgagggattcagagcaagccctcggcatcttagaagacgagttgcagcggccgcagctgcccgtctggaagaagtgaagcccgtggtggaagttcaccatcagagtgagcaagaaacttcagtgaggaaacgaagaatcaagaagagcagccgagtccagccagaattttatcactctgttcaaggtgcttcaatcaggaggcctagttccgggaacgcgtcctatcgctgctctatgtcttcctctgcggatttttccgatgaggatgatttcagccagaaatctggctccgcatccccagctccgggagacaccttaccctggaatttgcctaaacatgagagatcgaaaagaaagattcaagggggctcagtgctggaccctgccgagagggcagtgcttcggatagcagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgnctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaat

SEQ ID NO: 306921 - DNA, 9659 bp, Homo sapiens
  misc_feature (786)..(786): n is a, c, g, or t
gtttgataactttctacatgtggcacattctcttaagtgctgtacacatgttatctcattcaaatctcttaacaatctcatgaagcgggaattgttattatcctaatcttagattttggaaagtgcttggcacatagtaggttcttaatctgagttagcttccttccttcctaaaggtttaacactttctgttatatctagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgnctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaat

SEQ ID NO: 306922 - DNA, 8716 bp, Homo sapiens
  misc_feature (1579)..(1579): n is a, c, g, or t
gcctccaccctccaccctcctccctccctctctccccggcgcgggcgagtgtctgcggcgcggcggccaggaaatgccgcagatgcgccgcgcagcatccccggtgaaggcagcgcgccggtcctcccgcaccgctgccgcggcctcggcccggcccgaagcacgcgcctcgtgcagggccagcagagcggtcagcgcggccgcagagggtccgggcgcccgccggcccccgcccgccctcgccgcacgccccgctcctccgcttggcgtggcgctgctcgtcgccgcccctgggctcgctgagatttgccgctgctgaaacccgagagggactcgggctcccggagccgggcggcccaccatcggcctgcccggaggcctgggcgtttcctttgccggccctggcgccggcagccccctgcgcccccgctctgcgtcttcggcttccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgnctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcctttttgggatacaggattttctttattcaggtcaaaaaaatga

SEQ ID NO: 306923 - DNA, 4954 bp, Homo sapiens
  misc_feature (1579)..(1579): n is a, c, g, or t
gcctccaccctccaccctcctccctccctctctccccggcgcgggcgagtgtctgcggcgcggcggccaggaaatgccgcagatgcgccgcgcagcatccccggtgaaggcagcgcgccggtcctcccgcaccgctgccgcggcctcggcccggcccgaagcacgcgcctcgtgcagggccagcagagcggtcagcgcggccgcagagggtccgggcgcccgccggcccccgcccgccctcgccgcacgccccgctcctccgcttggcgtggcgctgctcgtcgccgcccctgggctcgctgagatttgccgctgctgaaacccgagagggactcgggctcccggagccgggcggcccaccatcggcctgcccggaggcctgggcgtttcctttgccggccctggcgccggcagccccctgcgcccccgctctgcgtcttcggcttccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgnctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaag

SEQ ID NO: 306924 - DNA, 1530 bp, Homo sapiens
tgaagaggatggtcataaagtctgtgtggaacagatgtcagagtggaattttcagacttaatggagaggatctaagtaagctctggattttgaaatgagtgaatctatggagctgtgatctcctacaaatcaaatggggaatgtctgtggatgtgtaagagctgagaaagaagaacaatatgtagatcctgccaaaactcctttgaaccctgaaaaatactctcctggaagaaaatatttcagaagaaaaccgatcaaaaaaactggaggtgacaaagagtcagttggggcaaacaatgaaaatgaaggcaagaagaagagcagcagtcagccttcaaaagaacagccagctcctttatccaggggactggtacagcaggaatctgttaccctaaactctgcactgggagatggtattcagcaaaagaagacagaagttgtagctgacagcgttaaacagaaacttctgccgagtgctgtaagcagttggtctgactgtgtgaacacttctcctgctaaagacagtgaaacagaagtaaaagttagtgaactggatgaaaggatttcagaaaaagacagcactccatattgcgcaaagaggaagaaacatttagatgatgtcaacacaagcgaaataacattccaggaaaaaactgatgttttttctttccgaaaggcagccagcttaagctctattccctcgggtatagaaagatcactcgaaaaaagtgggtttcctgaagacccaccaaaaagttatagcagtattcaagaaaagcaaaacactgagagattttgccctcatgcaacacagcattttcagtttaaaaaaaagagatgccattccctttatactagtatgtcctctgtttctaaggacacagatggaaatgagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggtatggaatttgtgtattttttccttatacaactgtaagacacatttctttcatctctgaattttaaaattatcttttattattatagaagcaaaagcatggcaaaaaattagaaaatacagaaaaattaaaataaaaaattggccaggtgcagtggcccatgcctgtaatcccaggacttagggaagccaaagtgggtagattgcttgagcctgggagttcgagaacagccttggcaaaagggtaaaaccctctctctacaaaaaaatacaaaaaattagcttggcatggtggcaagcacctgtatttccagctactccggaggccaaggctgcggtgagctgtgatcatgtgactgcactgcagcctgagtcacagggtgagactctggcttaagaaaataaaaaaaaaaatttaaaaatcacatttccactacttagaggccatgattctgaattgtagcttata

SEQ ID NO: 306925 - DNA, 530 bp, Homo sapiens
acatgttgtttgaaaaatatacccagatgtatatttttatgtcgtggtgctataatttctacttttttccccttcaaaatatctaagttactggaaaatttcaacttaggaacaaatctgttggagaaagtgaggtatgtttaagtgtttatttcttaaggaaagtaaatgttctacataaaaaatgattattgagataatcactgttaactaatttaaaaacaaaaaatgtcatttaagaggcccatatagcatcaatatcaagtaaacaattatgtcaccttttgctttaggaaaccaaatatcactgctaacccatatgtcgtctttttattttttcttcagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaattta

SEQ ID NO: 306926 - DNA, 1608 bp, Homo sapiens
  misc_feature (1)..(1): n is a, c, g, or t
ncccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaattta

SEQ ID NO: 306927 - DNA, 610 bp, Homo sapiens
gcttcagtttcctttacagaaaactgcgtggtgggaatccaggccaatacagaaaggatcaacaagctgatgaatgagtctctaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaa

SEQ ID NO: 306928 - DNA, 2703 bp, Homo sapiens
  misc_feature (1)..(1): n is a, c, g, or t
ncccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaacaaagaaaaaacaatatagtgaagtacaataaacaacacaaacaagggacggacgtccagcgtataatcacatcagcacaggaggaagagaatatagcacagatagatacatggtagaagaaagaaggccaacaagctttaggggagaaaaaaataccacacacaaatgctgagcccaacatgaataacgtcacaagcagagaaaaaaataaaagcacgcctacgtaaacaaacaggctaaaaaacacaaacaagataaagatatgtataggatatcaaattgacgataaaaaagaatcagatcaagaaaagataaagtataagcagagagaacgtcgatcaacagaaacaacaccgagccgaggcctcagttcgagctggggagcaacgaccaacgcgacaatagcacgaagacgaagataagaataaaatacgaagaacaagaagagaacaaaaagaaaaagaagacagggaaacaagaaaagaagcaaacgaaaaagaaggaagaagaaagaatagtataggggagcagacgacaagagaacgagagagaaaggaacaagagggaagagagaaagagggtgcagcggagggcgagagaaaggggagaagaaagaacatgcgaataggaggtacagacgaacaagacggagagagacatacaagctaaaggaaaaaagaaggaggaagagggagggagggaagagaaatacgaaggtgtagaaagagaaaagagagacgaaaaagacgactaaaaggaaaagggggaagaaagggagagaagaagaaagcaagaaagggagacatgg

SEQ ID NO: 306929 - DNA, 1636 bp, Homo sapiens
  misc_feature (1)..(1): n is a, c, g, or t
ncccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagtcccatctctatagggtatgaacaggcgcaaagatgtaagacgcacaaaatggtcactaaaggacgttcgaatggtactaagcgaacttgccacggttaaccggaccgggcaggtactaattcagaaaaatttatataaaagccctttaagagtggagagcggcactctcagaggttacgggtcgggacaaatataaacctcgggagctctctagattcaaaattaacaaa

SEQ ID NO: 306930 - DNA, 1579 bp, Homo sapiens
  misc_feature (58)..(58): n is a, c, g, or t
  misc_feature (71)..(71): n is a, c, g, or t
ggtccctcaacgggtcagccgcaccgccccttggcgctcgcgcccgtaaactctacgngaccaccggacgngttcggctcctcgcgcgctcgcgtcccctcgtgcgggctccagccgcagccttagcttcggctcccggcttgggtggcgcggccgtgccctcgttttggcctccgaacgcggctcgaatgcaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaattta

SEQ ID NO: 306931 - DNA, 1370 bp, Homo sapiens
gggccgttaagttgttactttactggcccgtggtctacaattaacatgaataacgcatgacaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaattta

SEQ ID NO: 306932 - DNA, 1671 bp, Homo sapiens
tctagaggatccggactgtctctcctcatccggtacctctttttttcattaagaatcctgcctggaagtttaggtcaaagaggctgcttggagcaaaatacagtggtgtctcatcccaaatattctccaggcgtttcttccatccttccaggatttgaattcgggcgacactcgagtgtctcgcgtaggtgagagctgttgcatagccacagtataacttcacatgttcattaaaaaggcaaattgaccgctaaaacttcaaagaaaaagtactcataaaaaaaggggggacactcgagggtcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaattta

SEQ ID NO: 306933 - DNA, 1230 bp, Homo sapiens
ataatacagttctgagtatgtgttagaaaccaggatgctgcttatttgattctataataactcacctatgacatgccacacatacatgtaactgagctgggttttgagtagttagttggagagttttttaattgagaagtttaattcagaagtttgtttttgttgcctctgatttaacattttatatttcttttgaaaaatttccaacagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaattta

SEQ ID NO: 306934 - DNA, 1670 bp, Homo sapiens
  misc_feature (1)..(1): n is a, c, g, or t
ncccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccaggtcagtatgtgagctttgctgttttttggttataaattgaaaagcatacctgagattgttcttgtaaaacaagcattcactttttgacaagaagtgttcattatttaatggataaggcttcttatggttcttatttcttgaaggaatcttggttttatgtttcaatccttataaaaattatttttaggacacctgaatttagtgtatgtatttttttattgtttaaaactctattttgaaataattttagatttataagagaattgcaaagatagttcaaatagtttctatatcccttcactcagcttcccttattgttaacatcttatgtaaccatggtacatttatcaaaactaagaaattaacatagatacagtactcttagctaaacaacagactttaaaaaaaaaacaaaaaactgaggctttcctcagtttttccactcatgttctttttcaggatccaatcaatgctatacattacatttagtcacatgtccccttggtttcttctaatctgtgacagtttcttggtcttttgcgattgtctcagtcctttggggctgcagtaataaaatacaatagactgactggcttataaacaatagaagaagttaatttgtcacagttctggcagctagaagtccgaggtcaggccactggccaattcattggcttggtgggggcccactttttggtttgtagatggccatcttttctgtgtcctcacatggtagaagggacaagggagctctctggggtctcttcgtaaggacactaattccgttcatgagagctttgccctatgaactaatcaccttgcaaaggccgcatctcctaatactattaccctaggggttaggatttcacatagcagtgaccttgacactttgaaagcagtggtcaggtatactgtagaatgtcctcaattctggtgtgtctgacgtttctcattagattgagacttttgaatttttgagaaaactatcacagaaataaagggcccttctcattgcatcatatcaggggttcatgatagcaacatgacttttactggtgatgttaaccttaatcacttggtta

SEQ ID NO: 306935 - DNA, 697 bp, Homo sapiens
acatgttgtttgaaaaatatacccagatgtatatttttatgtcgtggtgctataatttctacttttttccccttcaaaatatctaagttactggaaaatttcaacttaggaacaaatctgttggagaaagtgaggtatgtttaagtgtttatttcttaaggaaagtaaatgttctacataaaaaatgattattgagataatcactgttaactaatttaaaaacaaaaaatgtcatttaagaggcccatatagcatcaatatcaagtaaacaattatgtcaccttttgctttaggaaaccaaatatcactgctaacccatatgtcgtctttttattttttcttcagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaa

SEQ ID NO: 306936 - DNA, 406 bp, Homo sapiens
agagaaaataatggttcttgctggtgaaaagattgagtactaaatttgtttttatttatagtatatgaaataaacacatataatttattgtgtgtatttgtgcataggattgtattcgtgtgaatatgtgtgtatatgtatgtgggagacgtacacacatatatatatgaagagtcaatgtatttgtttttatttggttccttaaacaaatagatctatgataatgttgattcttggttcatgaattcctgtctataatctttctctataaccgaaacattttagagctatagtgttactgttttattgttattgttttatgtatagcttttgcatctgccaaaataataaacttccatgcttaagtaaaattgtaaatttgaaatatttttctgattaattttag

SEQ ID NO: 306937 - DNA, 1775 bp, Homo sapiens
  misc_feature (1)..(1): n is a, c, g, or t
ncccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaa

SEQ ID NO: 306938 - DNA, 1847 bp, Homo sapiens
  misc_feature (1)..(1): n is a, c, g, or t
ncccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaaggaaaacagacttaaattttctcctatgttaattgacttgtattatagttgaatctatgatatttgtgcatg

SEQ ID NO: 306939 - DNA, 1634 bp, Homo sapiens
  misc_feature (58)..(58): n is a, c, g, or t
  misc_feature (71)..(71): n is a, c, g, or t
ggtccctcaacgggtcagccgcaccgccccttggcgctcgcgcccgtaaactctacgngaccaccggacgngttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaattta

SEQ ID NO: 306940 - DNA, 1688 bp, Homo sapiens
gggccgaggccggggcgttttgaggtaacttcgctgctgctggcgcgcaggcccccagccccggggcgctgccctcaaggacagtgccggcgtgggcggagggtgctgggagaggggcagctcccgcaccgtcctgccccatagctgggccttgctggccggacactggccgcctgtgcatctagtggtttctgaactgtggtttgtttcgccaaggggcactgcactgctttcaggccctccaggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaattta

SEQ ID NO: 306941 - DNA, 1554 bp, Homo sapiens
  misc_feature (1)..(1): n is a, c, g, or t
ncccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaattta

SEQ ID NO: 306942 - DNA, 1161 bp, Homo sapiens
tcgctgactgcattctcgtactctcatacacttctgatggtactgtgattacttgactcttaaacaatggcgatgatggggctgtgactttattatggggatactcgagagtcgcactgatcgtgtgcatgctaggcacaggtcgtactgataataacgctcagtgactggcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaattta

SEQ ID NO: 306943 - DNA, 2492 bp, Homo sapiens
tgagacaaggcctcactctgttgcccaggctggagtgcaagtggtgtaatctgggctcactccaacctccaccaccttggctcaagtagtcttcccacctcagcctcctgagaagatgggactacaggtgcacacctcacctggctaatttttggattttttgtagacaatgggtttcatcatgttgcctcaagaaaaataacatcatggtaatactaagtcttttatcagtgacatgtaactgattttaaaatattatatagtgcttcctagtttaaccaaactggaggcatgttttatatgatgggctgatgtctcatgaataactgtgccaaaatcctcacttctgagtgcactgatgcagtagatggatgtctcagatccctcagctcccagattgggccaactctccttataccaccacacctgggacctgggaggaatggggaaggggactttatagggcagagctttcccagactcttgttccaccctaaggataaagtattacagtaactttcttcctgccttccagaggcactttcattcttcctggagctctcgtcaaccctgacctcttcctttgtcagcaaggtcaaacgcctgagccacaagtcttagctgtttccagaagggtgattgtgtgctcccacctatatctgaggtcctagactcctcagaggaagtcagcttcatgtgatctaggttactcaagcctggggctagtgttttcatattctggtatgagagacttgcttcctctggaaagatctttatggtttacacaaatgtaacagaccacttaacaatagctagtctctaaaatgtacatcttaaaatggctttatacttacgggaattcctaattaaaaaaaaaactcacttgatttatatcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatcccagctactccagaggctgagattacaggtgcccgccacatagcccggctaattttttgtatttttagtagatacggggtttcaccatgttagccaggatggtctcaatctcttcacctcgtgatctgcccgcctcggcctcccaaagtgctgcgattacaggcgtgagccactgcgcccggcccttttttttttttttaaactaatatttatcaaggaggcaccagctgccaggcagtgaagagcttccaaacagcaactcattggctgcccagaagcaccctgtggcgcagagtcctttcttaggccacctttgggcccagaaaactaaagtgacttgccaagtccacacagccagtatgtgctaagccctctgacttgagagaccgagagcgtcact

SEQ ID NO: 306944 - DNA, 3593 bp, Homo sapiens
  misc_feature (3020)..(3020): n is a, c, g, or t
ccgcgcccgcgcccccgccgcccccatgggcgtgcagggcttccaggactacatcgagaagcactgcccgagcgccgtggtgccggtggagctgcagaagctggcccggggcagcctggtgggcggcgggcggcagcggcccccgcagaccccgctgcgcctgctggtggacgccgacaactgcctgcaccgcctctacggcggcttctacaccgactgggtcagcggcggccagtggaaccacatgcttggctacctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaaggtattatcaaaggggccctggagtggcttctgttatttgatgagtggccattcctatgggtgttttgtccttttgtccttttttgaaccatttttctgtcttactaatctacttgaaacaaagttcactttcccctttctaaacattgaatgaaagatgaacatttataactgtaaatagttttaaaataactcgtgaaaagtctcacttttttccttcaacttagtatagaatattttatacttctaatgaaataatgcatcacattattttatgacttgtaattttattctttttacttcaatttcagaattttcttaaaccatatttgtgctgtaatgtcaggtttaattctgatgtcagatacaatatctggttcctttatcatttgtgcttagaaaataatgtttccccctttgaatggctcatagtgcttcatgtgttttgacttgttcatgacctcattgagtgcagttttaatagtgctaagaacaaaaaatataatacaggattttgttaacatacgcatagtcagaaaatgaaactatcattttatacagtgtcataatttcactttattagtgtcttaatgtatgcttaaatatatacatatagtgtggcatcaattattttttaatcttggtgtctcaaatgtatctatgtgtatttaaatttcctcagtgatttgtagtctttatgttggcacttttaatcttagccccacaatttaacaagttacctcagttactagattaatcctgcagaactggtttattgctatcatgtattattaacatgaatacctatatgaccatatataaccagacttttctgtctattctctacaacccatctgtggtttgtaaaatggagtcaataaatgcaataatgaactcctgttctcaaatactcctgaggtggacttcaactgttaactgactaatccaaatattgcttacttttattaattaaaggacatggaaaacatgtagccagtactatttgctcagatcctttaatttattttttagttgtaatgcctccaaatctcatctattatttgatatgggtatgcatttatagtatcacttttcagattatggttgtaaggtgaacattttatttttcaggttcaacataaattataaagggtaagtgaaaagtaattgttgtggggaaaacattttgctaagtttaaggaaccaaagttttgggaagacatctttcaaaataaggtgtgaagaaacaacactcattcctngtggggctgtttgaaatgtaaggtccccaggagctacctgttatgtccacactgctggatctgatgcgtggatagtcggttagatctatatgagggttgcaaattgtaccgacatgctttcttatttcttatgaatttcaagggcaaatactgataaaatgaccatggttgagaaaattgtcttttcacattttaaaatgctacttaagttttttcagtttatcctataagctgaatggctctggtattaattgcccaggctaagacatttacagtgagatgcatctttatggtaatgaagagaatttgcaaagcatcatattattgagataaatattccctagatgagagtgttagaacacatgtagctactggattaatgaatatgaaagtatggagggtaaggggaaagaccagtttttaaattaaacttatgtgaatgaaagaaacagcaaatattacaaaattattatttaaagcatatatatcaatgaacttcatagacattgaggtcataaatgcattgttgtgctctgagtataattaaataaaatttgttgcatgaaatcttga

SEQ ID NO: 306945 - DNA, 921 bp, Homo sapiens
cggggtccgcggccgcgtggggacacttgagggctgggagagagccccggaccagaattcggaggcgacagtgtcatcatccccaatatccttagtttttcccatcctatttgaggcgggcaggctatcactcaccttcaactttgacaaaatactcccttttctaatttagcctgttctttcccagcaacaggttcatcttggaagcaggcaggatacagagtaatagagggggtttcgccagagcccttgggggctgcaaatatcagtgctgctgccgccgcccttgccaatgttgttagcccggtgacagcgagacgtgtctaagggccagtgccctggcctctacttcagaacgcagtgccctgtccgtgttcctcttagtacagggtgtttagagaatctttctatggctttttgtgttagatttcaaagacccgtgcactttgacaggatgggattttgtcagttctgtgacttcacgtccgtgtgaaagaggtctttaaggcagttcggttttgtagatcccatgcgaaaggagtcgctcaaaatcagggggcgaactacgcgggcgtgaactcgcaggatttatttttcgggtgcacagtaagtattcagtgaccttcagcggtgccctgacgggtgggtaatcagagctctatatcaccggcctcctctggccctttggcagagggcttcgcagctggcactgggccagaggagaacttcaggacccagcagtgactgtgaagataagcacatccatgatcctggacttcacgttctgattgcttgcttttttcattggttttcttgaaaacaattttgggggcctttttgttgtcttagctcttgacactcggtcttccatcttgtcatttgacatttccttgaaactgctggagctgaaagtttgtgaaa

SEQ ID NO: 306946 - DNA, 961 bp, Homo sapiens
cattctggtcgtctgtggcagtggtccgggttgttgcgctggtgtttgtgggcttttcgtcgggcatggctgtggtgtgtgcacggttccatgtgggtgtggtctgcaggctgtcctggccttcaggccttgtcggttggctctcttggtgtgtttctttcgtagggtatgcgtccagctttttgcctgtattcttcccttttctaatttagcctgttctttcccagcaacaggttcatcttggaagcaggcaggatacagagtaatagagggggtttcgccagagcccttgggggctgcaaatatcagtgctgctgccgccgcccttgccaatgttgttagcccggtgacagcgagacgtgtctaagggccagtgccctggcctctacttcagaacgcagtgccctgtccgtgttcctcttagtacagggtgtttagagaatctttctatggctttttgtgttagatttcaaagacccgtgcactttgacaggatgggattttgtcagttctgtgacttcacgtccgtgtgaaagaggtctttaaggcagttcggttttgtagatcccatgcgaaaggagtcgctcaaaatcagggggcgaactacgcgggcgtgaactcgcaggatttatttttcgggtgcacagtaagtattcagtgaccttcagcggtgccctgacgggtgggtaatcagagctctatatcaccggcctcctctggccctttggcagagggcttcgcagctggcactgggccagaggagaacttcaggacccagcagtgactgtgaagataagcacatccatgatcctggacttcacgttctgattgcttgcttttttcattggttttcttgaaaacaattttgggggcctttttgttgtcttagctcttgacactcggtcttccatcttgtcatttgacatttccttgaaactgctggagctgaaagtttgtgaaa

SEQ ID NO: 306947 - DNA, 5117 bp, Homo sapiens
ccgcgcccgcgcccccgccgcccccatgggcgtgcagggcttccaggactacatcgagaagcactgcccgagcgccgtggtgccggtggagctgcagaagctggcccggggcagcctggtgggcggcgggcggcagcggcccccgcagaccccgctgcgcctgctggtggacgccgacaactgcctgcaccgcctctacggcggcttctacaccgactgggtcagcggcggccagtggaaccacatgcttggctacctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306948 - DNA, 6623 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306949 - DNA, 7774 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaaggtattatcaaaggggccctggagtggcttctgttatttgatgagtggccattcctatgggtgttttgtccttttgtccttttttgaaccatttttctgtcttactaatctacttgaaacaaagttcactttcccctttctaaacattgaatgaaagatgaacatttataactgtaaatagttttaaaataactcgtgaaaagtctcacttttttccttcaacttagtatagaatattttatacttctaatgaaataatgcatcacattattttatgacttgtaattttattctttttacttcaatttcagaattttcttaaaccatatttgtgctgtaatgtcaggtttaattctgatgtcagatacaatatctggttcctttatcatttgtgcttagaaaataatgtttccccctttgaatggctcatagtgcttcatgtgttttgacttgttcatgacctcattgagtgcagttttaatagtgctaagaacaaaaaatataatacaggattttgttaacatacgcatagtcagaaaatgaaactatcattttatacagtgtcataatttcactttattagtgtcttaatgtatgcttaaatatatacatatagtgtggcatcaattattttttaatcttggtgtctcaaatgtatctatgtgtatttaaatttcctcagtgatttgtagtctttatgttggcacttttaatcttagccccacaatttaacaagttacctcagttactagattaatcctgcagaactggtttattgctatcatgtattattaacatgaatacctatatgaccatatataaccagacttttctgtctattctctacaacccatctgtggtttgtaaaatggagtcaataaatgcaataatgaactcctgttctcaaatactcctgaggtggacttcaactgttaactgactaatccaaatattgcttacttttattaattaaaggacatggaaaacatgtagccagtactatttgctcagatcctttaatttattttttagttgtaatgcctccaaatctcatctattatttgatatgggtatgcatttatagtatcacttttcagattatggttgtaaggtgaacattttatttttcaggttcaacataaattataaaggggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306950 - DNA, 6644 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaaggttcaacataaattataaaggggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306951 - DNA, 6744 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctgtaatcccagctactccagaggctgaggcaggagatcacttgaacctgggagagggaggttgcagtgagctgagaacacatcattgtactccagcctgggcaacagagcaagactccatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306952 - DNA, 6485 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306953 - DNA, 7073 bp, Homo sapiens
tgagacaaggcctcactctgttgcccaggctggagtgcaagtggtgtaatctgggctcactccaacctccaccaccttggctcaagtagtcttcccacctcagcctcctgagaagatgggactacaggtgcacacctcacctggctaatttttggattttttgtagacaatgggtttcatcatgttgcctcaagaaaaataacatcatggtaatactaagtcttttatcagtgacatgtaactgattttaaaatattatatagtgcttcctagtttaaccaaactggaggcatgttttatatgatgggctgatgtctcatgaataactgtgccaaaatcctcacttctgagtgcactgatgcagtagatggatgtctcagatccctcagctcccagattgggccaactctccttataccaccacacctgggacctgggaggaatggggaaggggactttatagggcagagctttcccagactcttgttccaccctaaggataaagtattacagtaactttcttcctgccttccagaggcactttcattcttcctggagctctcgtcaaccctgacctcttcctttgtcagcaaggtcaaacgcctgagccacaagtcttagctgtttccagaagggtgattgtgtgctcccacctatatctgaggtcctagactcctcagaggaagtcagcttcatgtgatctaggttactcaagcctggggctagtgttttcatattctggtatgagagacttgcttcctctggaaagatctttatggtttacacaaatgtaacagaccacttaacaatagctagtctctaaaatgtacatcttaaaatggctttatacttacgggaattcctaattaaaaaaaaaactcacttgatttatatcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306954 - DNA, 5155 bp, Homo sapiens
ccgcgcccgcgcccccgccgcccccatgggcgtgcagggcttccaggactacatcgagaagcactgcccgagcgccgtggtgccggtggagctgcagaagctggcccggggcagcctggtgggcggcgggcggcagcggcccccgcagaccccgctgcgcctgctggtggacgccgacaactgcctgcaccgcctctacggcggcttctacaccgactgggtcagcggcggccagtggaaccacatgcttggctacctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctaaactcctctttagtaaacacacaaaaaaacaaaaaaaaacaaaacacaacccaccacccacacaccaacacaacacaacacacaacaacacaagaaggagaacaggaagcggcgccgaggggaagggaacgacagaagggcggcaaagcgggaaccagagagcagagacgagggggggggggaggggcgtgagaggaggaggcgcggcacggacgggg

SEQ ID NO: 306955 - DNA, 4424 bp, Homo sapiens
ttctagagtatcccccgccgaagcattcactggctatttgagcatgcctcttagaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306956 - DNA, 6565 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttctgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306957 - DNA, 4498 bp, Homo sapiens
catccactgaaaggaaaatccagttcttgagcttcagaacgtgaacggcttaggaaagtcttagggccaagatcttacaagtggacaatcattgggcactgataagatcttagatggtagctccttgttgaatttctggctcctgcattcagattagcctggtactggttgctcaccatccactgttgacacttacgtttgttttctcaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306958 - DNA, 3425 bp, Homo sapiens
gcttggtgcctatgaaaagctggtttataaagaggctgtacggtcggaattccgggatatcgcgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306959 - DNA, 3184 bp, Homo sapiens
gtgttattttacgaagagattgtggagccctgggctctaaggagaccacacatcattgctcattttgtcacacgtcagccttaagtacagtgttactctacactgcggaacgctttataaacccaacctgaaatacttgagtatgtttataaaatattctcttaaattcaaatgtgttaaatcacataagtatttctgttcaaatgaggccagtgttaggtcaatataaggtaatggtaggactacttagtggtgctgttttgttgaggaatattctgttaactttggagagttttactaagactttgaaagaatttaatactgtagtactcttattccatagaaattactcttttcaatttaaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306960 - DNA, 2679 bp, Homo sapiens
gtgtgagccactgcacacagcctttaacatcatttataatgtttgcataggatcccatttatagtattatgtaattatttaattaaccattaaataattaacaattattaaataattaaccatacaattttcaattaaccaggtgccttaatatttttaaagtattagttttcaaatcaaatgcattggatatgggagatgtagctcaggggtagagcatttgactgcaaatgcattggatatgaaccaaaaaaataagattgattccttggaataaatcttccctatgatcatacttaacctgtttacgcctagtgttccattattggaacgcaaagcatgtgggagttctttatgtcctactgctcaaggtctgactgcaaaaattcaacaaattgcaacttccggcataaatgggttaattcagtgcttcataaaacgtaagattggatggctttaaaatcatttgatactattttaaatgttgtctgtaacagatttaagtgtttactgttgtcctttttcattcatttaggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306961 - DNA, 2207 bp, Homo sapiens
ccgccagcccgcccgcgcgccttttcaccagacgctggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306962 - DNA, 2141 bp, Homo sapiens
ttgacatgggtggagttacatcacgggggaatgatcatatgctccaagttgacggtgcaaccgtaatccccacagggatggtattgggggtgggggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306963 - DNA, 2230 bp, Homo sapiens
actgactgagacaggtagagcatctaccgcccaaaagtcaaagcaaagacagggttagaaggacccagctgggcattttctgctcttgaatctgcagagagtgtcattaggccaaaattggcatcctctctcttctgtttatcagaaaccaccttctcatttgttgtccttcattttaaacagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306964 - DNA, 5931 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaagagaaagaaaatgaagagcatttgactcccgcacttaaaatgaagtacacataaagtttaaactggttatgacaaaagcctatagttgtgtttcttgaactataaagaaaacaaattttggcagtctttaagtatatatagcttaaaatataatttttagcatttggcaccatatgtatgccattatatttgattttgcattactgtttcacaatgaagctttctttaaggctttgatttttatgattatgaaagaaataaggcacaaccacagtttttctttcttaaatttcatcactgttgatgtggttcttttgtgttaaaaaaaaaaagtgcaactatcaaaactaaaaaattatagagtaatattgccgttctgctgattttaaatatacaatacatcatacatactttacaagcaagttaaatggagataaagttgaaatcatagaagatgcaaatgacctttcaaaatcaacacaatgtgttctgaaactttcgtgactaataccatgcatctgtgatcaatgaactatgtggttttgaatcggatgtagaccattagtactactacttgagctaaacttctgcatggttcataatttttaaagtgtgtagttaatatgcatgttatcgtcctttcttccattcttaacagtatgtgcccatttgcaaaacaaaaatgctaataatcagtaatagtcctataaaagatgttaactctgtttagtcattgactgatcttgctctaaccttaaaattttgtgattattgacctctgttgcatttattccgtgccccccttctgtagcagggaccaatgcgtgtt

SEQ ID NO: 306965 - DNA, 4305 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaatagtatgtgcccatttgcaaaacaaaaatgctaataatcagtaatagtcctataaaagatgttaactctgtttagtcattgactgatcttgctctaaccttaaaattttgtgattattgacctctgttgcatttattctaaagccccccaaaaattatctagccgtttcgaatatcaacattaccctggtgtattcactgctgtatgcattattgttctttgttgctgttttatgccttcatattagcaaatatgaaattctgtgaaaaaaaaccctttgatcttaaaaaaaaaaaaaccaccccccccttctgtagcaggaaacaaattgcttgttcttgagaactttcccatcaagaatttagtagaagcaggtatacttctatcattttgatgtttttgttaatgtttccaaacaatgtactttgaaatcagaatcacttcttatcgttttcatatacttctgatgctcttcatcacattagtgatcagaaatgaggtgtaattccccaacccctgcccgcaagagctaagtaggatcttactgtaagttgaagggagttttgccctaactcatggattgtgcaagaatgaactgctgttgggtttgattgactgtcgatggattgtggtgtggtgtatctgaaggctattgaatgcaacttacaatgcttaataaaaatctttattcttttaggtataaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306966 - DNA, 5264 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattttcaccagtgatcattaaagaatgggcagcttacaaaggaaagtctcctcaaaccccggaactggttgaagctcttgccttcagggagtggacctgccccaacctgaagaggctgtggttgggtaaggcggtagaggacaagaaccgcaggatgagggccttcctggcctgcatgaggtcggacaccccagccatgctcaaccctgccaacgtgcccactcacctcatggtgctctgctgcgtcttacggtacatggtgcagtggccgggagcacgcatccttcggcgtcaggagctagatgccttcctggctcaggcgctgtcccccaaactctacgagcctgatcagctccaggagctcaagattgagaacctagatccccgaggaattcagctatcagctctcttcatgagtggagtagacatggccttgtttgcaaatgatgcatgcggacagccaatcccctgggaacactgttgtccttggatgtattttgatgggaagctcttccaatccaaactcctcaaagccagccgggaaaagaccccactcattgacctctgtgatggtcaggctgatcaggctgccaaggtagagaagatgcgccagagcgtcctcgaggggctcagcttctccaggcagagccacacgctccctttcccgccgccacctgccctgcccttctaccctgcctctgcgtacccccggcactttgggcctgtcccaccctctcagggcaggggcagaggctttgcaggcgtctgtggctttggaggcccctatggggaaacggtagcaacaggcccttaccgtgccttccgtgtggcggcagcatcgggacactgcggagccttctcaggcagtgacagcagcaggactagcaagtcccagggcggagtccaacctataccttctcagggaggcaaactagaaatagctggcactgtggttggccattgggctgggagcaggcggggccgtgggggccgggggcctttccccctgcaggtggtttctgtcggaggaccagctagagggcgtccaagaggagttatttccaccccagtgattagaacatttggaagaggtggaaggtactatggcagaggttacaaaaaccaggcagcaattcagggcagacctccttatgctgcttcagcagaagaagtggccaaagaacttaagtcaaaatctggggaatcgaagtcctctgctatgtcttcagacgggtccctggctgaaaacggagtgatggccgaggagaagccggctccccagatgaacgggagcacgggtgacgccagggcccccagccactctgaaagtgccttgaataatgactctaaaacgtgcaatacaaatcctcatttaaatgcactaagtacagacagcgcttgccgcagagaagctgctctggaggcagctgtcttaaataaagaagagtaaacttattttttatagagggtgaaggatgctggaagggtaaggatttaggaatatctggagagaaagagagcctgcagttatgtacattttgtcctttccgtaagagaaaaatgaggactttggaaattcagatccctctttgatatcagagatttaaacaacacatttttagttttaaccagttgtagtcaaaatgctacaataaaacaaaaaaaaaaaaaaaaaaaaaaaaaaaaaaaagaagaaagcagaaaagaagcagaaaaagcaaagaggaaaaagaaaaagaaaaagagcagaaagaatgaaacaggaagaaacagagaaggaaagaaaaggaggcaagcagaagaacaagaacaagaagacacaatgt

SEQ ID NO: 306967 - DNA, 3701 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaagggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattatgtactgtaacaatccattgtttgttttcctcggtacctcgtaatctcttgtgcattttctaaagccttagaagaatcatgactgagttgaccccgagtgcctctgtgtaaaggaggtgggcccatcatcggggcagtaggccagggtaaaggctcttagaaaaggaggagaagccacagactttcttcctcagtaacattccaataatgatgtttattcagtaaaataataaaacaggtttacactttaaagtgaatg

SEQ ID NO: 306968 - DNA, 3722 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaaggttcaacataaattataaaggggtgaaatcaaaattgctgtttctattgaagatgaagccaacaaggacctgcctccggccgctctgctctataggccagttcgtcagtatgtttacggagtcctgtttagtttggcagaaagcagaaagaaaactgagagacttgcttttagaaagaacagacttccaccagaattatgtactgtaacaatccattgtttgttttcctcggtacctcgtaatctcttgtgcattttctaaagccttagaagaatcatgactgagttgaccccgagtgcctctgtgtaaaggaggtgggcccatcatcggggcagtaggccagggtaaaggctcttagaaaaggaggagaagccacagactttcttcctcagtaacattccaataatgatgtttattcagtaaaataataaaacaggtttacactttaaagtgaatg

SEQ ID NO: 306969 - DNA, 5099 bp, Homo sapiens
  misc_feature (4526)..(4526): n is a, c, g, or t
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctggcggcgctggccaaggcctgcttcggcggcaacatcgagctcttcgtcttcttcaacggcgcgctcgagaaggcccggctgcacgagtgggtcaagcggcagggcaacgagcgccagacggcacagcagatcgtcagccatgtccagaacaagggcaccccgccgccaaaggtctggttcctgccgcccgtctgcatggcccactgcatccgcctggcgctcatccgcttccacgtcaaggttgcacagagcattgaggatcaccatcaggaagtgattggtttctgcagagagaatggtttccatggcttggttgcgtatgactctgattatgcactgtgcaacatcccctactatttcagtgcccatgccctaaaactgagccggaacgggaaaagtctcaccacaagccaatatctgatgcatgaagttgccaagcaactggacctgaatccaaatcgttttcctatttttgctgctctcttaggaaatcacattctgcctgatgaagatctggcttcctttcattggagtttacttggtccagaacatccactagcctcactaaaggtccgggcccaccagctggtcttgccaccttgcgacgtagtgatcaaagccgttgctgactatgtacgcaacattcaggacacctctgacttggatgccatagctaaagatgttttccagcattcacagtctagaacagatgacaaagttattcgatttaagagagcaattggatattattcagcgactagtaagcctatgtcatttcatccaccacattacttagcagccagacccggtccgtttggaatgcctgggatggtgccgccgcatgttcctcctcagatgctcaacattccgcagacctctctgcaagcaaagcccgtggccccacaggtgcccagcccagggggcgccccgggccagggtccatacccgtacagcctctctgagccagcacctctcactttggacacgagcgggaagaatctgacggagcagaacagctacagcaacattcctcacgaagggaagcacacgccgctgtatgagcggtcctcgcccatcaacccggcccagagcggcagccccaaccacgtggattccgcctacttccctggctcttctacatcgtcatcttccgacaacgacgagggcagcggaggggcgacaaaccatatcagcgggaacaagattggctgggagaagacgggaagccactcagagcctcaggcacgaggagacccaggagaccaaacaaaggcagaaggctcgtccactgcctcttcaggaagccaactagccgaaggcaagggaagccagatgggcactgtccagccaatcccgtgcctcctgtcgatgcccaccaggaaccacatggacatcaccacacctcccctgccccccgtcgcacctgaggtgctgagagtggccgagcacaggcacaagaaggggctgatgtacccctacatcttccatgtcctgacgaaggtattatcaaaggggccctggagtggcttctgttatttgatgagtggccattcctatgggtgttttgtccttttgtccttttttgaaccatttttctgtcttactaatctacttgaaacaaagttcactttcccctttctaaacattgaatgaaagatgaacatttataactgtaaatagttttaaaataactcgtgaaaagtctcacttttttccttcaacttagtatagaatattttatacttctaatgaaataatgcatcacattattttatgacttgtaattttattctttttacttcaatttcagaattttcttaaaccatatttgtgctgtaatgtcaggtttaattctgatgtcagatacaatatctggttcctttatcatttgtgcttagaaaataatgtttccccctttgaatggctcatagtgcttcatgtgttttgacttgttcatgacctcattgagtgcagttttaatagtgctaagaacaaaaaatataatacaggattttgttaacatacgcatagtcagaaaatgaaactatcattttatacagtgtcataatttcactttattagtgtcttaatgtatgcttaaatatatacatatagtgtggcatcaattattttttaatcttggtgtctcaaatgtatctatgtgtatttaaatttcctcagtgatttgtagtctttatgttggcacttttaatcttagccccacaatttaacaagttacctcagttactagattaatcctgcagaactggtttattgctatcatgtattattaacatgaatacctatatgaccatatataaccagacttttctgtctattctctacaacccatctgtggtttgtaaaatggagtcaataaatgcaataatgaactcctgttctcaaatactcctgaggtggacttcaactgttaactgactaatccaaatattgcttacttttattaattaaaggacatggaaaacatgtagccagtactatttgctcagatcctttaatttattttttagttgtaatgcctccaaatctcatctattatttgatatgggtatgcatttatagtatcacttttcagattatggttgtaaggtgaacattttatttttcaggttcaacataaattataaagggtaagtgaaaagtaattgttgtggggaaaacattttgctaagtttaaggaaccaaagttttgggaagacatctttcaaaataaggtgtgaagaaacaacactcattcctngtggggctgtttgaaatgtaaggtccccaggagctacctgttatgtccacactgctggatctgatgcgtggatagtcggttagatctatatgagggttgcaaattgtaccgacatgctttcttatttcttatgaatttcaagggcaaatactgataaaatgaccatggttgagaaaattgtcttttcacattttaaaatgctacttaagttttttcagtttatcctataagctgaatggctctggtattaattgcccaggctaagacatttacagtgagatgcatctttatggtaatgaagagaatttgcaaagcatcatattattgagataaatattccctagatgagagtgttagaacacatgtagctactggattaatgaatatgaaagtatggagggtaaggggaaagaccagtttttaaattaaacttatgtgaatgaaagaaacagcaaatattacaaaattattatttaaagcatatatatcaatgaacttcatagacattgaggtcataaatgcattgttgtgctctgagtataattaaataaaatttgttgcatgaaatcttga

SEQ ID NO: 306970 - DNA, 2262 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctttttcaccgggagtatgggggcttctttggccaaaccgtgcgcgtgcaggctccatgtgctgggcagcagctgtccggccacagcctgtcggttgcatcctgctcctctacagaggtttctgccgcggaactgcattctcgcgctccttcctgctctttccaagaagccaggcgcggccggccagcatcccgctctcccggaccccgcagtcagtgtgggcagcaggcccagagtggtgcgagccgacggcggcgttagaaaggcggcgtcccgacgaacagagtgactcggcctcggctccccttcaaagcgccatcttatcgctgcttccctcaggagcaggcgagctcttccccaggacctgcttcgcggcttcccttcgcccgagaaccaccgggcggaggcggcggcctctctggccctgccgggaacagggcgcaggggaggggagcggcggccgaccggcctgaggcgggcgaacggcctctggcctccaggcgctgcctgctccggctcagaagcctcccggatcccgtcccggcccaactccgggcctccgcctccgccgccgcctccgggagccccgagccgcgtcccgccggcgccgcctcttccgcc

SEQ ID NO: 306971 - DNA, 2383 bp, Homo sapiens
atttgttcgttcttctgttttcctctttttgttcgttctttttgtttcttcttgctgtcgcgtgtctgcttctcgtcctgttcttctcctgcgtctgctcgggcttattttataatccttgtctctcctttgtccctccggttgtgtatactgtcccgctgtttgttctctcccgtggttcccttctttcgagattttggtttctcacaatcctgctcttgtgttttctctctcccccgcttttttttatttgtgtggatattcccctccgttatttgtgtgccgcggtgcttctcctgggtatctctttttgtctactgttctaccttgacccttgtggtgccccctcgtcgtcactactcttgttttctataaacctttttctcggtcccctctttctcgccaaacaattttttttttttttctttttttttttttttttttcacattgtaaaatatagtttacttcaaaagatgatcctgaagatcccatcacagagtgtttaagggatgattataaacttttagcccttaagagagaatatatatactcaactgagtactgtctttcaaagcagtccctgtcagtttgtccattgattccatagcagctctcactgcccaccctgcttgagaagcctcttggagttgcctagagagtctatagcactcatctgaaggccctccatgagaacaactcttctcttccacatagatatttttgcatcagcccaaagctatttggacacaagtttggtgaacacggtaagaaaaaaacaaaccaagcaacaaaaacaaaaagcaggcagtgctgtgttagactgaaagtaaaagataaaaactctaagaacctatgaagcgccagggcagtgctggttgctttcacccatatggtctcctttggtgttctgctggtgcttatgaagcagtatccctactgacaatgaccctagcttaagagggctgagaactgctgaaagtgaagctgtttataaatggtacagtcaggaccgacagacacatgggtgtggtatgactgcaaagtacctgtggaattcagatgggattaccatccccactataaagggcaatatgatctgttgcaggagggtttatagggtacttagttacacaggtcacactgatccccttttcctctttttttctatgcaagtatctatttgtctatatgtctgtctaccttggtaggttgggctccttgaagaagggttatgttttcttcatctccatatccccagtagctggccaatgcccagtatacaccaggggctcagtcgctgtttgtcttattttcttgttgactctactctgacttaggacatatcactttcctctcttgaccttcacattcagatgtgttaataaaagtggataaagaccactctagctttaaaacaccctccaatatagagagaactctgaaaccagaagcagaagctgaggaatggtgaatagagcattttccctcacacgatgggtatcagggtggtttcttgtcctttcaatgcctctgcagaacttgaccctagtttttcaaattggactcaagaatgatcttagtgttggtggttttgtggttttctttgagactttgttattgacagaacagcttctggaaatctgtaatcccagctactccagaggctgaggcaggagatcacttgaacctgggagagggaggttgcagtgagctgagaacacatcattgtactccagcctgggcaacagagcaagactccatctttttcaccgggagtatgggggcttctttggccaaaccgtgcgcgtgcaggctccatgtgctgggcagcagctgtccggccacagcctgtcggttgcatcctgctcctctacagaggtttctgccgcggaactgcattctcgcgctccttcctgctctttccaagaagccaggcgcggccggccagcatcccgctctcccggaccccgcagtcagtgtgggcagcaggcccagagtggtgcgagccgacggcggcgttagaaaggcggcgtcccgacgaacagagtgactcggcctcggctccccttcaaagcgccatcttatcgctgcttccctcaggagcaggcgagctcttccccaggacctgcttcgcggcttcccttcgcccgagaaccaccgggcggaggcggcggcctctctggccctgccgggaacagggcgcaggggaggggagcggcggccgaccggcctgaggcgggcgaacggcctctggcctccaggcgctgcctgctccggctcagaagcctcccggatcccgtcccggcccaactccgggcctccgcctccgccgccgcctccgggagccccgagccgcgtcccgccggcgccgcctcttccgcc
